United States Patent 9,976,180 (METHODS FOR DETECTING A GENETIC VARIATION IN SUBJECTS WITH PARKINSONISM) - sequence listing, part 19

SEQ ID NO: 298 - DNA, 877026 bp, Homo sapiens
gcaagacacattagttccttaggtgaagaatgtattgctaagcacatgttatacaccctaataaggtttgctctcattttgtacctggttaattcatgcagggggagcaaagcatggtgatttagagctccatgtctgtggaaagacagactttggttcaaatccttttttttttttttttaatttactgtatgatgttgggcatattacccaaactatcctaatcccaatttgttcatctacaaaatgtgaacaactgtaatcgtatgtttgatagtgctatagcatgatttaaagaaaatacttagcatggagctaacatataatatgtgctcaattcatgttaaataatgataaaatgataaactgttaatatgccatttcagtctctttacttctttatatgaaaatttatgattccaaactgagacaagatcaaacggaataaatttgaggtaacacaaggcccacctacctataccaaattatcattttctctcctaagagcagcagaggtatttatcgaggcttagtattatttattaataaaaaattatagacaagctgttagtgaactgctaagtgcagtatcatattcagctctaccacatcttgaaatagtgggcttcaattcatgtttcatgtgcagattagtattcatattatttacattaaaaggagtagaaattggtagtaaaattcttagagaatctttggacaatggtcctttcatgtctctgttcataatcttggtattaaggcaatttactaagccttatttatgcttcaaacattgtattttagaatgtactctcatggatatttcctcatttgctcttcctgtgtactcattcttatttctagttaatgtaaagagaacactgagtctcagagaggttaggtaacttgtattcagctctataaaatttgcctgcgtccttttttttcccccaactgcaggtgccattctgttaccactgctattataaacaaaccatttgtggcttttcaaagatgtcctccccaagggaaagctgatataggcatcatcttattcccattgggctgccatcacaaaatactgtagacttgtaaacaacaggaattggcttgtgaacaacagaaatttgttgttcacaagttctggaggctgggaagtccatgatcaaggcaacagcagacttagtgtttggtgagatgtctggtgagggctgatctctggttcatctagctgtgtcctcgcatggtggaagagaaaaacaagctccctccgatctattttataagaacactaatcccactatgaaggctctatcttcatgtcatagtcccacctcctaatactatcaccttaggggttaggtttccaacctataaatttggggaggacacaaacattcatttcctagtagggactgactgcaaggacagaatcatgactccatttacaccactcagagtaaaataaaaatgttttctctttttccgtaacagtgagattgcttttctacagaactcatgaatttatccatattgtattgccataggacaatcttacattccaagctctttgtatgaatatttcaaattggggaaatgaaagcagctagctgaacagtctgaaaatgtagcaaaggcattctttgctggttttgttattctgcttcactctctttgattaaaactggcccactgacaggatttcctgaaatgaggttcaagttaataatcccaaatacaagcatcttaagaaactcattctctgtaccagtctttagttaaaaacttagtatggcttggatttaagctgtagataatgaggtttaagaaatccaggggagaaatacaagctttctcaaatagcactagtaataaaaattctatttatgggctaaaggtatagaattgaggcacagtgtgcttctactagtgtatgtagagctttaatttaactcgaaatcaggatgaactaggtcagatggttaagaagtgtattctctgtcttcagataaaattaataggatgctccctttgtaaaagcataaagacatgacaggatgaagtaaaagtccatatttatggcaatgcgtattccagaagcacgaaaccacagcagaggaaaagaaaaaagaaaaactttgcttttatcatctagtagtatttcacaattgtgaagaatcacatttcaggcaaccttcatttagaaaataggaacaaaataagaaaaggcttttgcaatgctccttttgaaatacaaggttcaagaatccctcatctatggtctgaggaatctttgaataagagaattgcttcatattggttttctttattgagatttgcatccaagctcaatttttgtaaaaagagagaggggagaagtgtaaaattggagtttaaagggaaatgttgccagaaacgactgatatctgtagttaaaatgataatggcaccatttgttttgactctgtaacatcagtttcaagagatttaacgataatctccattctgaagaccccttcaaagatccaccttcctccatggtgttctttatctgattaatatattaacttttcattttaaagagatcatttatcttgaagcaaaacgaactcctagtaaatactgcattgctagtatcaacatggacaaactacacagagtctaaaaagaatgctgaagccacagtaggagaaacagtctattagtgcttttaatttagtgggtggcaactcaaaggaattagaaggtagatcacaataaattagcgtgctctggaactctaagtggaggagaactggcaggtaataatttagttgaaattacccatctaaaggtgagtatcattccaaaaagttaattagcattgttagcagctgcaagctgggtatttagctcagatggcatatggaagccatctgtcacaatgcctggtacatagtaagcactcagttaatgattattaatattattttaaaatatctaattttcctataccatttccttcagtttggagagcactgtctgattgctttcttccctactgaaatggtactagatgattaaccacgttaaagaaaaaggtcctccacacccacacatccatgtctcacctgaaagattcctgcccttgtcatgatgaagtgaacatgactactatgatcaaggttgtatctccatagcagctaggacattaaatggtgagatgcaggaaatttacacacactcatgcttgtgtagccgtttcattcatagtgtggagatctgatttcagtgtataaatgattcgtaaatcagtttgtatcaaatgcgtagtcatatggatcccttaacagagagtaaaagacaaatacatgtgaattaggattcctggttttgaaatgatagtaatcacattataataatcttaaaatatttttattaattgaacactcaaacatattgtttaataggtgctaggcagtatggtaagcatgtgacatgaattatcttaatcctcaaaataagcctatgaattgtgtactattactaattaccatgctataaatgagaggcgtattaatctattcttgcactgctataaagaaataacagggactgggcaatttataaagaaaagaggtttaattggctcacagttctgcaggctgtacaggaagcataacagcttctgcttctggggaggcctcaggaaacttacaatcatggtagaaagtgaaggggaagcaggcatgtcctacatggctggagcagaaggaagagagagagagggaaggtgctacacacctttaaacaaccatatctcacaataactcactcactatcatgagaacagcaccacggagatagtgctaaaccattaatgaatgatccacccccataatccagtcacctcccaccagatccccaccttcaatactggggattacatttttacatgagatttgggcagggacacagatccaaactatgtaaagaagattcttgcttataaatgtgcaacaaaatttagctaaggatgagagccacatttctctctttactacatacatagtattatactagtaaaccttattgtaattgttattattattattaacacagaatggtatctcttggaaaaatacgcttacattaaaacattaaagctcgctactaaaataattttgtttttcattgattccagtttttcccacccactgtccatttaggatggcttcagaaaagagaaatggtgtcaaatctgaagcagtttatttagtgtcttcataaaaaattctgggatgaagtgggaattgctcattaaaatgcatacatatttttaaataacctgtgttttgcatttattctttctgcctctgtaccttacattaccaatgataagcaagaggaacatggcattcagatttagcagttatataactgagctgaaaaaaatctcaacatttaattaggaactgtgaaattgtataaacctgcttcacttttctcccattaaaaactttgttaacacagactattgccgcaaaatgcatttgattagacttttcttatttaaaaggtttttatcattattttttgataatttgttgttttttcttgctgtgaggattctaaaatatctagagcacacactataatagccaggaggaatccaccatatcatgtaattcaatcacacagatagaaactaacctagctagcatttgaactgaggcattcagaatctatttgtcaggtctgttctggatgaatacagcaggaaaatgactcaaaatgggcttaagaaaaaaataatatattggctaactgaaacgttcaaaaaggttgatgcttgtttgtttttcggggggtgggcatcaagcatgccttgagttaggtgtgtgaacaattccaagtttctttcctctgtgttagtttcggatttcagagatgctttctctatttggtggaaaattattgactagaatcttggcgtttatacctcactgtctcaaaaaacctcagtggaaagagatctcctcttcaagagccattctgcaagcagtcctggaactgaatctaattgtctctggttggtttgtcttcatccccgtgtttgtctagtcaaggtggctatgccctacaagcctcttatggcaagacctgaattatgtgctctcacctaatgccagaggtgtggtcagcccaactgaaatgagatggggaggattgggctttgtaaggaaaataaaaatgcaggttaaaaaaaaaaaaaaaagcaaacacatgtcctctgcagatttagaatccaggacattaattcttgtaaccatcttcaaaatggaacaatataacttttaaagcccagtactgtaccctgaatcttataaccttctccttaattgaatgttttatcagacttacaactccaaacacaattgagaaagaagaaaaaaaggaaagaaagagagaaggaaagaaagaaagaaagaagagagagaaagaaagaaaaagaaagaaaattctagaggagtttctttcttagtgagattttcttgtctcttttaagtctcatgtctcttgcgtttcttgccttttgctatcattctggtgtgattgtagctctgcagagcaataagttctcaacatatgttcacaattcatggtttttcacaatggttctactactaatttttttttttgtcttatatgccattcatgttcaattctctagacttccatttggatgtgtgtctaaagcctatataaaaatactataataagaaatacttaaggtttcctacagttggtattttaactaaagtagcacatgattagagcccgctgggaattctaattaattgaatttttaagaggcagaacctgaaagtataattttttgcaagtgatttattagatgagtttttagaaagaacccaaaggaaaagagggaagtggggcagggaagagatagtagccaagctcggtatactgtcaagcaaagttccacagaaggtaaatttgattcaatcctatagctctggagagaatacaggtcatacctagagttgtctcacaactaggagcacgggagctggagaagttataccctagaagccagtcatttattggttaatggctgctcctgggggtatgtaaattcctaggtactttcagttctctctttgtgaagataaattagctataacagcttgaggacagtgtccaaaaagagataacatgtactggctcttaagggtacaaagtacataggaatctggggcggaagagggattagaagggacgtgagtccagcactgacattttctgctacattactcgtctaagaaaggtgtatctaaataggagactccatttcttgtatcaaagggaaaaaatgcttgtccagtaagactttaatgttgtcactgagttatttttctttggacaaggtggaattctctttacacccacacaattgggccacttaaaatggagatccacttttgtaaagtaacaaatacctaggcttcaagggaatgatctaattaggtttgtgcaaaagtaatcctacttttgccatgacttttaatggcaaaagccgcgattacttttgcaccaacctaacacaacagctgtgaagtcagtattcctttgaattatactcatagcttctacttcaagaaaacctgaaaatgaatcccagctccgcctctttagctttagaaaagtaagtgaaattatatgtacgtattgtacagatacatagtacttggtactctgtattgtacaggtactgtgagtctgcataatatatgcatataaggtagctatttgttgtaatattattacaattatcataattgtcaaaatgttcagttacttaggtatttagttatgttaaaaaatgacttctgtcttcacaatcaatataaataactaagagcagagggaaaaatacacaatttttacttatattttgtctgaatgttttagattaaaagccttttcaattggatactttgcatgtatttgttataaatctcagagatttgctgtcataaaaagataaaggatcatgaattcagacaaatattagagctctatttttcctttgtaaaacaattttctcagaaaatttttattacactggtaatgcatgctcattgcaggaaaataatgaaaaccagaaataaacagagagcagaaaataaaataaaataaaataaaataaaataaaataaaataaaagacatttatatcacaactacccatagataaaaacttcacatgcaatacatacaacatatgcatttttaattgaataatacctcatatcctataaaattcactagacattgtgaatatctatgtgaataaagttccttctagaatttcgttcttattggttagtatgccataaaatgaatgaaaaagaacatcagttatctgaggttaattgttgccatgaatataccaatttactgaaatgtcaacttaaatttgtggcaagtggcaaggctttttaaaaggacaaaaacttagtatatgataataattattttttacttaaggcaattcaaaattcaagttttcactgtaattgtatgttaattctgagaataattgaatcaaacattgatttagggcacattttctgacaaatatgtttgagtgcatatgatttttatccttgtgctttatccttgatgtacataggaggataataattttttccaataaaaatgtctaaggcttcataagtgttcttgcttgaagcttctactgagacatcccaactttctgcagttgtttactgctcaaactctccaaatctttatttgccaagcactttgcatgtagttggatgagcctcccacattccttctgctgacttgaagaaattctgcctcttcttcaaggtttaccaattgactttgcaaaatgacttactaccattattattaatttgaaatataattagaatagaattattcaaatcatctaaaaatctataagggaatgaagaatgacttgacaagaggaaaggagagatattaatgtgaacagactggggattcattttacaattcattagtttagtagtgaatattttccttctggaactttgcttgcagcctgcccgttcttattttatgccttctaaaccattaatttctaaattcatcccttattgttaaacacttagtttcatttattataacatgtatttttgctcctttgaaagatacccatattagactaaaaataatagatatgagaaagtagacgaaattaatattaataaagtaactttatttacaagttctttataacaggggacaggctgcggtgtaaatccatctttgttttacttttttttaaatcgtatataaatgagtactttttttgaggatcatagagcctatttaccagttcatatgggtctgttttatagtgctgttttccctggataatttacctcacccatcccatgtcttcagttacctattagtaccagtttagatctggaatactttatatttttgccttagaaactataaatatatatataaagcctgcctagtcttaaatgtcatgttctcacaaagaatttccttgaccactataataaattgacataatcttgttactatctctgcactctatttcttttgtttcggttattgcagtttgcaagtgtacttgtttttattatttgtttatggtatgttttcccactagtctgtaagcaacataagggcagaggacatgtctattttattcaccactattttccctgaacatagcacagtgacttgcatacggcaggcacttaataaagtgttaaataaatgactgattgagtgaatggcgaatgattgcatgatctgaaaactagtcataatacaacagattgatagaatatttttcttgagagttatttgtatggatgctcttcttttattttgctgtcataaagattaaaccgtcttctattctaatgaggtgtaactgtttagtccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatggtgagctaattggatttcaaatatatataaaatatttggtaatgcccttcataataaattgtggaagtcattagcatgttgtgaaaaagtgtcacgggagaaataaggaaggcatatttccgggtttagatgcttaacacaatgattagcagatgggaatgaccacctttaaaatatggttttaattttagcatggtctatgaatgctattgtttattatatttgccttcaaaatatcagcagtgtcatgttaaagccataaaagtttataataaaaggaagcatgaactccatatatttcccattaaacgttctgcagcagattatagcaatcttgattctaattctaagtagaattaataaatgaaaaaaattgataggaaaaatataatactgcatggtggtttataatatttgttcctagttttcatattttgtctactcataagtaggtaatataaaaagaaggcaattacattatttaaaattatgtttgtctcagttacaaaaatctctcgtaaacttaagagagacgatgaatgcatatattatctaaaagctgtctttgtgtcttctttaatccaggattgaaattttctcttacttaacattaagtaaacaatacaatatatctcagaatttgcaaaatgctgtatactattaaaagatccttaacttctttgataaacttaatgtatctgtattagataatttttaaaaagtattgatatatggccaaaatactttcctatgtgacatgtttataatcaatgataaagtaattagagaaaatatgtgtgtatgtgtgtgtgtatgtgtgtgtgtgtgtaataactagaaaaatccaggatactgtaattatcccataggaatgttgattgagtgcccgtggggagaacatattgtgtgtctgtaatattattttccattttctttagaatttccaactttaacctgcaatgaatactactattttatatatagaatataattttctactcattattctcctacagttttagcaaacctagccaagaaaaacaatattttttttcagtagtacctacactttaaaggaaagtctttggaatttagtatcctttgtaaataaaataggatacaaatgggagttttagtagaatgaagatattgaatgctttggctagttttaaagaaatattttccattttatatataatagacaaagatataatcaagggatgaaccagaacacaaaggtatctgtaaactggaaatcaataataaagtacctttctgtatactgataaagcaaatgttagcttacatagcaattttacaaacattcacttatagaattcttaatcttaagaagtagaaatcttaagattaatattaagaggtagaaacaatgttcagtgatactataggcaaaaatatcttaagttaattgtgcaggatctcacagatagtgattgtcagattcaagatcagaaccttgaaatgtcttctgaaactgccatagcatttcaacatggtggtctaagctcattgtactatatctcaccacaaccaaattagccatttaattagcctgaaatggtccttgtaggggaataatggatacttagtcaataacataatcattatgtttcttagtcacatattaattcactttctgaagtgctttcaaaagaaaagaggattactgactcagttacctcagagttgaataataactgagaaattcaagaaaagaatctctcagtctgttatattgctgtgtttaagttataattcagaaccaagtaatattgtatatccatctatatcgtaattttataatctctaaaagaaatctctaaagtattattcatcatagaaaatagaacatgttcagaggagttaagtggcttttcataaccagtcaatatggcagaaaaaaatctaaaactcaaacctgtatggtagacccaaaatcctaagcctcttctcccatgaatttcctacctagttttaaatttaaaactttgctctccagaattttaatcatccaaagaatgttcacgttgaataaataaatgtgttctgtagccgcaattattgcattaagcataaaatcagatatatctgaaacctttgtaagttatgtgaaattacatatgagcatgcatttattttcccaggtcagacatatattaggacaatttctaaacaaatacttatgaattatataattttgttaataatacccagaaacatgattcaatttcaccaatagatctagttcttctaagttttgccttgatttgtccctcaaggctgcaggaagcacattctgtaactggaagttgtcctgattcctgcaagaggtaatcctaggcttagttcccaccacccagagacatcatgatttcttttactcgtttgtagtctcattgaagggtcttctgtcttggtgaaggcaggttgtgcagtagaaaaactctagaagtcagacagacttgcgttttatattgtgcacaatttcgaatcctctcggccctgcttcttacttcagccactgctacggtggccagttcagcactgtgcgttgtagatgtaacctgaaggagtgttgtctcaggtgcaaaactaccaagcacatcttgttttctgttctgggttttctttggctccttcgtgagcctactcagcatttaagcatgcccagtttggatgtgccagtagtttacacctgcactacccttagatgaccatggatgggaactaaatgatcccccttcatttccctgggtagacagctctaaagactgcttagaagttgacataagatggagaacaatggatcgtgttggtggtcaactcaataactcagccttgcattgacttttttttccttcccggtgactacctttttttcctgatgcttttcccttgggctaacattctcaaatgaacatgtggaactcaagccctttacttaggttctgcttttagggttcaaattttggcttccctgttttctaccatgtcatcttgaacaggttacctaacatcgctgcgagaatccactgaaagattgtagagggaattaagtgcaattacaaatataaagcatctggcttgccacagcctgagagtccaagggaagcgtcatatacttctgtatatccaaggacagaactaaataaaggagagggattaattggcacctccaggcagtttccagtcagtttatgaaagagatattcatgtgaaaacatttaatttccaacccgcctgtttccatgaatgatggtaaaaataatacaatcttactttcacgtcaattatgccagtttcttgttgtctcactactatgaagaactttctcaaattaaagaaaatttggaaaactcacacccagaattaaagtaagatactgaacctgtataaaactccaaatgttcaccattccttgtcaagaattttatctaggaaaaaagaatactggattatctttctaccaaaatgccaggaagctcatgtttgatttatgcttcaaggtattgagttgtaattgtgtctgaaacagatacagatttattacttttagtttagagcaaatataatcagtgaactttcagatttattccacaggttcagatttgatatacattttctaacttgacctatgttctaatatttagcatggatttattccctggccctgttctacattttgcccttttcccacagctcccaagttgttatacaggtggagcaaaatgacagatgacaaacatttaacttgagccaaatgcccaatgatatttgcaacaggatttctgtcaacccgcattgaagctcctgcatgtcccctccctcaaatcgtgtgtgtgcaatccaactggacccagttagccttgtccttctgatctctacagcccttgtaatgtagcataatgtcttggataactgccttttaccaaacagtggcacttgcctttttgaaacagctcctccagaatgggaacagaaaatccaaaatacacacctctctatctatgacaacttgctctgggaatgtaaagctagtggaaagccaaacccttggtatacatggttaaaaaatggtgaacgactcaacccagaggtaagcaactatgttgatattaaaagtttacctactctactaggtaaattttgttactaacagtactagtaactaacagaaacagctaatgttaatggagtctttggtatgttccaggaaaggatgcatacactgatttatttaatccttaaataaacttacaaagtaacccatctttcaaaagagaaaaataagtgtagacaagacaaataactttcacaaaatcactgttagccagtaatagattcacatttaaatatcatcatcatcatcaccgtcatcatcgacacggataacacttactgaactctcatatgagccaagccctgtgttaaatatttttccgtgcattatcttattgcaccctcatgaaaacattataagagagatacaagtattattcctttatgtaaatgaagaaaatgagtttcaaagaggttaggctacttgtttaaggtcacacagcagctagtaaatgttagaattagcattttaaacttttattttggtctgatatcaggacccaatctcttagtcactacccagtattttgcttttatgaacactgacgactgtctttaaacccctaggaaagtaaataactaaggcagttatccacatttctccatttaaagcatactttcttctacaatacctagaaaatgaaagatttgttttttacctattaaattatccagataattgtgtcaattctccattttactttgcacatgtaggcatagccagagacacaaagaacatctgttgtttggaagctgaatataatgctgttctttgtttcagcatcagtgaaattttcttcctgcatgccttttgcatatagcattctgtttcctccagcctattttccttttccctagaggatggtaatacatgccttgaaatatttagtcttaagttatatttgtactattaattatgtcactatgtgcactcaaaattgtatttctataccccacatggggttctgtaacagattttggctgtttaggcacactttatagtagtttgtagaaaggaaggatttagctactccaactcaagactcaattagaaaattatcacatcatcacatttcaaatgtttttgaaacttttggaaaatggaaagccaaggcagtgttctagtcatgatatacatgtctaacattattgttaaccgtgttttcctggaataattaggacggtggagtattccaaattactatgtataccaaataacagaaagttaacatacattttgtgcaaagtatgtcaattgtcaaagaaatgagataacataaaacacactagtaaccactaaaattatcctaaacatattttcgttttttaaacttaaaaatgctgctcagaatctagtagtgtattaatacaccaaattatcagatctcatagatatacacaaatgttgtttaataacatatcctggttaagagaatgctatattaacgtacaagcatctttatatgccttttcctttattaggagagaattcaaatagaaaatgggacactcatcataacgatgctgaatgtgtcagattctggtgtgtaccaatgtgctgcagaaaacaaatatcagataatttatgcaaatgctgaattgagagttttaggtaagtcgtttatttacaaccaacaaattcaaaatgacgttttaacaagctataattatgcataatcccaacccaattttttttgtaaattagaaattgctgtcccatcaaataatgggaaatgtctaaattaactttttacaaaattcaaggtggtaattattattctgcttgggcaatgcactggggcttcagaaaaaaacccaccattgggtgcatccaaaccggaggaagctcttccaaagctgattctagcatgaatttttgagtataactcaaagaatatctttaggaatattttcagctgcaaattaaaaagtaataaaaaaatcacaattcacagtaactaaaagaaacagtaatttattttatctcttagcaagaggggcattggctgccgggcatggcacctcaacttgacaaaatcctttacaccttcccttcagcatcaaagcctcatggttacaagatggctgctctagttatagaaatcaagtctatgctcaaggcagaagagcgaggttacagaaataatcacatttatctcttttattagaaaagcagaatttcccttagcttccatagtaaactttttatgtcattaactagagttctgtcacatgaccatccagacatcaagaggaggtagaaaaataagtccctatagtgaaaagtgctgagattaaagcaatttgagaatgatattttgggaagtccaaccagtggtgtctgccacaataaatgacgcgttgatagttttcaacccaagggtttcttagtggtaggaagaacagaggagataaaagagaggaaggatcaaacaacaagacacaaagttttatgagcttatgggtgatgagcactcattcatttgctcattctttctatcgctactgtttgattgaacatttattatgtactgagctgtatcaagatgaagtgatctttatcttcactcaacctataatttcaaggagaaaaaagtgtcagatttaaaatatggcaattcttatggctaagaattgaggagttgctatcgttgcacatgacaagttgaacataacctacattgaggacattccctttaatctaagatcagaagtaaaaacatgcatcagtaaggtgaagggtagagaagcaacatctgaaaagcccagaagcaagagagcatggcatacccgaaagaacttcagttcacttgagctttagattagaaatggagactggacacatggattccaacattcatgaagttggaaagattcagaggcaccctgatagcctaataatttcttgtccttctgaactggcatttgttcaacatatatttagtggggaaaaaaccgacatagtgatacagcatttctgatttatttcaatagtattttattgctaatagcaataaaatatttctgatttatttcagttgctaaccacaatacaataccactgaaataaatcagattggtatatatacatatataaatcacatatatatgtatatatgtgtatatacgtatatatgtatatgtgtgtgtgtttcttcaacatcatatgttccattgcttatatacatatataataaatcagaaacacacatacatatatacatgtatgcatatacatgtatatatatggatacacatgtatgtgcatacatgtatatgtgtgtgtgtgtttctgatttatcatatgtatgtatatgacatgtatgatcattgttttggctggaatagactttcctggtcagaattaaaattccttcttcggcctcttttgaaaccatcttcatcctctttgttgtaaatgctattagaaaagtgactttgtctaacttgcctcctctctaccacttgcttttattattgcaatgaccaccaacaaaacaaaaataagttgcatttattgagcctatactttgcgccaggcactatactataattccctgcaactgttacatcatttaatctccacactaactctctaaggtaatatcttttgtcatcttcattttacaaacaaaacataaactctaaaatgttaagtcagtatttggtccaagaacaccttgagcaaagtaacctgaaaagaggatacagctataaatattagattctgtctagcatagcaagtcacccctggagtcactacatgttaactgagtaattaaacaattttgtctttgattttgtttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaaggtaaacaaatctttatttttaaaaatatttttgtttgtaatataacatcttccaaatttttaggttttagtaggcctttcaaaatttcctcttttatgataaagtctcattggcatacctagagacgccagcattcttctcatcatagtaaaattgtaaaaaacaaaaggatcttataaaataaagacctgtttgtataagttagctgcaatattttcagtgcatgcacttgtaatagatttttaaaaatcttttaagacctttttctacattcagtttgaaggcttcctcctgaaccagcctgctgagaaatcagtgcgaataacatttcacaaaggagagagacactcattggcacacacctggtgttgtggtttttaaatagtcacacaggtgttcaccccatgacaaaatgaattcaccacatgaagaaatgtagagaggttcctgtagagaaagaagagaggtttcctaccataatggatacagttgagaaaccctaggtcagcactggcatgttttctaggagactttgacaaaagaaaacaaacaaacaaaaaaaaagacgggtgtttttctctacttgtaatatcttttattctattgtaccgtagagccttgtatacatgaggtgactagaccacagatgctgctctcttttaatgactcacatgtgttactctataatcagatatgcaattaaatcctaatgtgaacgagccattgtgctgaagatatgaaaatagtccctttcgttcaatgagctcttcttcagcatcatatgttccatgacttatatgcataccaggatgggcaggtaaaaggccaggtgaaagaaaggacaactaaagtgtgttaaaaaatgacagttgttactcttggaagaaatgactgtgacggactagaaagtgagttccctacctaaaaaggatagtcacaactccaaattctgtcaactggttgccttgcgggaaatgagaactaggtttgtagaacttccaatgtttcagagaaagctagaagtctgcattctggtattgaatctcccatgccagaaaaaagtagccataggatgaatgaagggacatcattttatcacttctaatcccaagatttcatttgtggccgaggaaaaaagaggtgaaaacaaacaaaagcaggggtctctgtggtttgtgtagagtccctttgtggttataactgctgccttgaagatccattccatttacacaatgaagtgtacatcagagagcccctttctagggcattctttctttccttattctctgcatttctttacatccctggactaaagcttttcccaggacaggaattatgtcacatttatctttgtatgtcctgtgccttggcacagaaccaaaacttaataaatatctgtggaataaatgaatgaatcaaaaagggtgaacatgtaaagcgttaccagctttacagaaaggctgttcttggggaaatccctcaagacataggaacaggtgcttcagaactaaggtgaaagaaaaggtgaaaggaaacctgttgtcctgactcaggttgggtctcttcttctgtgtgcattgcctaggagatttgctcccaacagatttagatgtgaattctttttaaatgtttcctcatgcattcctaaaatctaatcaaggtttgaatacactgctgtggaacagaaaaacataagagatcctgcagtatcaaacacagcaccttgtactgagggtctggacaaattgattaactgtgcctcatttaataaagtaactcacccaaggagcagaatgatggcatttaccttccacaagctttaaaggtccaaacacgaagtatgtgggaacaagaaagaaaattaggaggagaatttgagtaaagctaagataatgagagagagaaaaaaaaaagctaagataataagaaaaaaaagcaggagggaaactgctttttaaaacagctcttcaggtttttgttttattttgttttgtcccatacagaataaatttggggtcattttcacctcaccacagttactaataatcatatcagctcagcattgtctctctgtgattaagggaatgaaccctgtgagttctatttatacattattctttcattctatcttttcattgcttcagggtttcactgcaggtcttaacaaaagaaaacatacatacaaacaagcaaattatctccttactgtgcattcttaaaagttgaaaataattgagctctagcagaatgtagtaattacagtcactacatctccacccggtagagattacactgagcagtaattttcaaaaggtcacacagttaactccatgagtctatgtccctgcacactttctagcttgtcctttcttctgttgccatctgatcgactggctttattaagtgcatggcttcaagctgtttgttgagaaatacagcatctatgcttctgtttgtgtcagactattgccttttttatagtcttatcgtgggacttccaaacagattgaggtaaaaaattagagtagtgataagaaagagagaaagaaaggaaggaaaaaaggaaggaaggaaggaaggaaggaaggaaggaaggagggagggaaggaaggaagagaaagagggggaaagaaagaaagagagagaggaagcaggaagggcaagaagggtcactgctgtttactatagacgtggtgtgatatagtaaaaagatttcagcccccaccctgttgagagcctgactttggcaaagtcatttgtcttctatagaacttcatatgtaaaatgaattagaggtacttcattttcctaaaaaaggagagaaagtcaaatggtttcttcaagcctgttcaggcccaaggttgattatttcttctacatctttggtctgaaccattacgtggtagccaaattcttttttccctgatcagaaccccctcttctttttcaaaagagtattgacagaacagatcctaaatcctagcaaagtagctacatttagctttcaaattgtcatggctttaagaagacaatattaacgaaagctttggagaagacaacatcaaaatagcagttaatttcacaaaatatgttttcttacatttgaatacataaaaaagtttatttgattgagtatgtatgtgtgtatttgtgtgggtggggtgtgggtagatgggtacctaggaattggcatcagatttccaaagcaaacaaaattaaatatattaggagccagggacagagtattgcacataaaggttgactgggcaatttatttttagatttgattacaaatgcaagggttattgcatgtgtacatacactgttcaatgctatatttgaaaggagcactagagataatgtatcccattttccgaatttacagtgccagatcctaaactcaaacacagaacgctgagcccagtacacattttttaatgccacaccagactgattatttcactcaaatagcaatatatacataacttctaccatctcatacctctgttaaaacatgacacagttgtatatatatgaagaataaaaaagtcagatataggaaaaaagttcaaaattttacaatgattccaagtagaaatggtttctagttcttgaccttggaaatacctatgtgaggaaatgtacatttttagtttctgttgtaaaacttctatatggtactgtctactttgaaatttcattgtcactaactcttgcagccaataaagtataactacctagagatggttgagagggctctaaagaaacctattcaaagtaatcagactgaagtgctgacttataaaaaaatggtggcagtatatatattttgacaatttcttctagtcttacatgaattgaaacagcttccatcacacagctaataagtgaagaagcttagacttggtgccaagtcttccatctctgtattcacgtcttttcctctctatggataatggagtacacgctcagctcttcagtttttgaaaggctgttgtcacatgattcaacgtaatttgatgtgttgataattcagattaagttacatttctcaatacagtgaacatgtttcttattagcctatgtgccataattgaagtcttggctgttttaagagttctgttcctaaagcaaggatctgtatttatagcagcctgtcagaggagaaaagtgtttctcgaaccaaaaataggtagatggcattacagagtccgaagactgcctggtttcctgctgggaatgaatggtcatgcaacatctgtctcattctttttagacccaccagtggtttagaaatagcacttatattgaagagaagcaaaaggcatattcctgcaggagaaccaggaagcactgggaattagaaaacacgggttgtggtctcagatctatcactgataagtggcgtgacttgagtagaaatgctagactcctctttttattttttttttttttttgaggccactatttcctggatttatcttaagatgaaataatatgaaaacaactttaggaaatattaaacactatattcatgcagtgtctgcttgcacagagattacattttagaaatcaatagagaaccttagcccaaggggttgaaattgaaagttctatcttagttataactttatatatgttttaatgatttgcttgggtgaccaggtgactgagccaaacacggcaattgctgtgaactgtcaaaacagctaaaatgatttggttggatggattcagagtttacagagagccctatcagctaggctgtaagctccatgaaggcaccgagcaccattctttaattcaccattataggcctagcatccaccacaaacctggaatatagcacacattcagtaaatattttctgtgttgctaaattaataaaagttaaaatttaatttgtttaactaattttagagattttgcagctaagccaaaaattttaataattaatagaccgatggtatgattattcatttattaatttcttcattcattctgcaaatatttgctgaacacctattataacctaactgggtgctggggataaagtgttaagccagatagccacataacatataacattcttcttgccctttcttatgataatgtttttctttaaagtgatttgaagtcaaagatctgggttaaagtcccaactctatttcttagctgataacttctagcaagtcctttaacttcacaggttctcagctggttcatttcagagaaaatggtacttgtctctctgatgaggttataagagactcagattttatgtccggaatgacaggtgagctgtacacacactgctacattggatgtatttgttgctgtcatcgtaacttgtatgcatatcccagttgtgcatgcttttacctctggcagccaaggaacaaccacggaaaatcaggatgaattacagattaagtttatctctgcaaggcattctcaggcaactgagggaatcaattccacatctgctaagtttgattaatcacttctttttttccttgtggatctacttagcaagtgaactgacagaaatcaaagtcctagatttgtccccttatgcccagtgactgctgtctacctattcaggaatcacctcctgaatttaataggaagtgttaacccactggagagacagttcaatgttgttctctgacaggcagcattaaatacaattcctgaattacctggggtttggtcatagcggacatacaagctatcaacaataaaaacaaagagatggagaaaagaaatgttgtcctattattggaagaataccattatacaattgaatctggttgggtgcagtggctcatgcctgtaatcccagcactttgggaggccaaggtagaaggactgcttgagttcaggagttcgagaccagcctgggcaacatagtgagaccctgtctctgcaaaaaaattttaaaaaggaatggggtggaacatggtggcacacccctgtggtgccagctaatggatgggggtgggaacgggtgttgaggtgggagaataacttgagcccaggatgttgaggctgcagtgagccatgattgtgccactgcactccagcctgggtaacagagggagaccctgtttcaaacaaacaaacaaacaacaacaacaaaaaaatccctgaatctttggtaattgacagcattttctctcattttccttaaaaaaaaagcctactgcactttgcccagatttcttaaaatcaaataaataaaataaaataaaatacagctaaatgtcagaaaaagtctcattaataatgatgataaccactttaagcaccttctacatgctagatggtgtaccaggcactttacatatctcaaaacattaaagcacatttttttttcatattcagatatatttctgaggatcacaattgtcaccgattatatgattaaatttgtatcatttttaccctagtaatctcaaaaagttaaacacaaaggcatttttaaatttacagagaatcaaactgactcaattacagagattctaccccttagcaattggtttcagaaagtgattatattccccagaattgaaatgagcggacagctggactctctggaaaccaattccgttacctttatctacttactccaagtatatatatttgcagacaggtgttatcaaatcatggattctgtgtgatttatcctacaataatgctactgttaaaacctgtgtggccctggacacttggcaaatgcatgtaccttgtgggaaagagtgaacccattaggtgaattggagtcttattcaattattgaacaagcggtgcttcttcaatatttttgccttcaaacctcaaatttagagcagacccactgcacttccacctgcctggctccgcaatgcccagacaccttcctcttggacactatattccattgtgggaaaactacacaaggaaggtataaagatcgtagggaaagtggaaagtggaagaaggaagccaaagtaagagagaaggaaatggtagagaaagaaagatgagagaaaggaccagggaattccctgtgacaagatagaagtgctacttattgagcaagtcactggatctttcttttcttcatgggtaaaatggtccccttgggaagacctgtttgaaagccgttagcataatgcctgacacagacaaggaacagaaaaaaattagtttgtctttattcttctcattgctaagttatgtggacaaagcagttcttctagttacacagccattgcccaatacttagctatcattacattttcttcttggaggtttttccaatcatctgatcttgtggaggcaccagctaatgggagtctggctgcctgaatgcaagacagccaattatatgattcttcctccctgtctgacacttctctacatattttacaatatctaccttctaaattattactgttccttttgcttttgcctttacccccaagtgctcagtcttaataaaatatctccgtcgcacatgccttttcaagacaacattaaccattatatagcaactgcaaagcaggcttctctaccccttcctcctctttgcagagcttcctaatggaacaagcaaataaacttaattttattttgtatctccaactacttaatataatagtgcttagtacgtcaggtagcatgagtatcaaacaggcaaatgaaccatatgttcccctgtttaaggaagaatgacagtctgcataatgccaggcttattacaatctcccttctgtgctgcctctttgtaataaaattttaaattgttcatactcaactcctgagagccttgttaaggtgagcctttccaagggaatacatgttggagatgtcaagagccatctgatagtcttgcctgtttcacatgaagatgtaacaagctaaaatcctgtgtgtgcccctgtcagtcttgttttcattttcccctcttgccatccaattcccctttctttatccccactgacctccactgatctggggcactcacctttcacacagtgcctgcagaaccacccagatgccatggtctgaaaaagctccggttcattaaagttataaagcctgcctttaaatccagcctgcctaactcaatgtacgctgttttaccctgctgccttgtgttggcctattactgctgtagtccctctcccatgttttcgtgacaggtaaagccacccttggtggctttcaaccaagggtaaataggagaaaacaaagaagtttcacaaaataaatagcatcttataaattattaaactgtgtcttacaacagaaaatgggtaggcttccttgtagagtggctgtgaattcatgggctgcgatatcagtcagtttcaaatttgatcatgcaccataagaatcttgtgaaaaatgcagatcccagagccatgcccatgattttgatttagtaggtgtggaataggttaaggaacctgaatttgtgtaagttcactccctctgccttcaagagaggctgaagttgttgaataccacctagaggagcactggtttggtgcacacatatctacttagatagaaatgtgcttcattttatctctgttccaccccagaactttgattcctatcctagcagttcagccattcattctatctcactgttgaagagatataaatccttagttctcccctttttgaaaatgtgaatataattggctctagaatggtgtccacttattttacctcttgcttctaatttctgagtgacacttgtatcttcaaaattttacataaatattcaacagcaataattttatagacagaaaaggtcaattattcatgtaatttatacaaatgaccttttgttcttggtttgatttttgagaaaagaagtggttacttgataaattttaaagtataatgtccttttttgtttacttaaaaagaaaatggttgatgacagatctttgtcacacccacaccttctaatgccagtgagtgtatttaaaaaaataaataaaaataaataattagaaaaagcattgctgtctatgacaatccagtagaagaaataaaagctggagtaatagtatagaaatcagtctcattaaaaccttccaaacaagcagtgaagctgtcagagcactcttttttttttaagccactgactagaatttttcaattttttctttttttcatagtagaactttttaaattttttttcaaatgaaatgtatgcaagaaaacctttcattccacagataaaattgaactaatctggctaatgtcccggagggagaaccagaaccccactcaatgccctcctcaatccctctcaccctaaatctccatggtgtgccctagaaatcccctagctctccaaggagcatagtttgaggactactaatttgtagtgacaaatctgattctcaagtgtgacttgccaaacgattcatttatttataagtatagtggcaaaccaatttgacgggcgttgtgaaagattctgggtttataacttgaatgagctcagagtctcctggggaaggcagacaagcccacagctccggtgcagtggggcatgtgtcaccactaacatgtgaagagagtgagggcaattcactaacttggcttacaggagtctagaaaggtttcaacaggttgcaggtaactgaactggcagttgaagagtgagtgggaatttttcctggaagagaaaagtgggaggtacaggcttattacgagactgtcttactgtatatttggtatccagacttggtgtcatttcagaattttgggtacagatttcccttcctcaatacaagacacacttctcccgtgagtcctctaaatgcaagtaaagggtactcaaatcattttgcaaggcatccaagaattgactctttgactactcaaggaatgcttggatatacctaataacatatattttaattctatctccaattaaattaaccaaatacacccataaatctatcctccccatatttaaccatgagtttcattatataagaataataatgatgatgatatatccatttatatgctatccatcaagggcagatagtgtgttaagatgtttgatacatcatttcgttaaatttttacaacatacctatgagaggcatttattcatatttttagatgagtaaaactaaggcttagagaagttcagcatcataccgcgatcagtaagtgatagaaaaacattcagttctgagaagctctgactcaaagccttgtataatcttaaacacaacactgcaggattttaatgagatttctggtgtctatatgtggaattcaaggcagtccttcataatatacacatttttttgtttcttcagagttatactaaaaaaatcttctgaaaatagtgatatgcaaggtaaaactctatctttatgtcactaaaaggtatagaataagtcaacatgttgtccaaatactgatagatggagtcttatttattcacatcaatacaaaaatatcagttctttcagtggcacagcatcgtgaatacacaatgttcggaagactgattggatttttaacgtaacatacaatgtaatttttgatggcatggagaggtagatatgtaaattcagtaagcaggttaaagtcgctaagccccacaaaggaattaaaataggtataagactgtgtattataactaagaagaaagagttaaagttagcagacaaagagtcacacccaggttggtcccctattctcagccacttttgtaaacctaattttgtagactctgaggaatgctataattcagtagccaaagggaatccaggattggaaattccactagcatccatcactttcaaaaccatgttctatcttgatactcaagttttcagatactcatgtcctgaaatcatcagattacagggagctggagtgaaagggttaataatcattagcgttccagccctgttctctcacctttttatatgtgagggaagccgagaaccttaagtttcaagttggtggtttaaggtcatctgacttgaatctcatctgtctatcccaaagctttcagcagaaacaactttacatttataaaacttcaaagccctgaggaaatcacacaataggttcatagtcataaatgtaataatagcataggcagaatgtcctcacaatgttcagacttctccattctgttctgcataactctctcctctattgtattttcaatgtgttctcctctagtaactttgggagcatagtttgttggttttttttttttaatttatttctttaaagtcctgcattcacacatttttgtgtcctttgccaacttcatactttctagtcttttcttttgatttacttgggctataaggcatgttagcatatgaatctatgttaattctcttttgtgttttctcaggcatcccaaaatgctgcagcgaatggagacactttatctttcccttcttctactgaagagctaaatatttctctttggcctatttcactggattaatttagttaggctttccatctgatgctgttttgttaatgttaaattgtatttccttaacattttatgggagtcagcatagcagcacactctggcatgccatcagaataaagacacatcatggcaccaaataattacgctatttagcaactgctcttacctaccatctcctaatttgtgccataattcagtcaccgtgaatctgtgtttgtgttgcgtcagccactacaaagatcacacttaaattttttgtgtatattaaacaaggtgacacattatgataaatttagaggtctgaatatttgatgcttcctttctgctttggagtttaagacagttgaaccaaagacttaagatggaatcatttgttcactccagtaattacgcactagttgtaaatacaattacagacactaagaattctgaaaaagtagaaacgggcaccagtaacgttctcatttaaattaaaatgtatttgagtctatttctaatatctaggtaacccctctgaacaactatttgctaataaaaccctttcagttaactacctaaagaccctgaatcatccttgaaaaatcagttaatgggaagtatatccttagctatttaatagttaaaaatatgtatttctcgattttgttgaagagttgccaaaaaaaagtaacataaaagtactcaggtctatttcttttgtttgtttgtttgtttgtttgtggtggagtctccctctttcacccaggcttgagtgtagtggcacgatctcggctcactgcaacctccgccttccgggttcaagcaattcttattcatcagcctctggaatagctgggattacaggcgagcgccaccacacccggctaatttttgtatttttagtagggaaggggtttcaccatgttgttcaggctggtctcgaactcctgacctagttatctgcccacctcagcctcccaaagcgttgggattaaaggtgtgagccaccctgcctggcctgtctgtttcttttataagcacttgctttccagcaaaacatagcaaattggatttatttgttacctgtttatgatgtcacttcatgtaggttttcatttttgtttcctttcctttccctcttcctacggcccataaatatttaattacactctgcctaatataactcaatacagctgcccaaaggaacactattatttgcctggagctaggacagaggctaaaaaaaatactagagatcttattgcgacaattctgtgaatcagatgaatatttaggaaccaccaaacggggtctatattgttataataattaaaaacattttactctggcttgtattataccctttagtttcatgatcagaactgaaaaaaaataatgattaagatttgttttatacaccaagtcttatcctagtgatttgaatgtagagttgaccgttggacaacggggattgaactgtgcaggtctatttatacttgagtttttttcattaaaagttatactgactgtgcctgcctctcctgcctctcctttcacctcctccacctctttcacctttgccactcctaagagagtgagaccggacacctcctcttcctccttctcctcagcctactcagtgtcaagatgatgaagaactttattatgatcctcttccacataataaatagtaaatatgttttctcttccttatgattttcttagtaacatgatatcttctctagctgactttattgtaaaaatacattgtataatgcatataacatacaaaacttgttcatggactgtttatgttatcagtaaggctgctggtcagttggagactattagtagttaattttaggaagtcaaaagttacaggtggaatttcaactctgtgagaatgttggcaccccaacccctgcattgttcaaaggccaactccatttctttgcatcaacttttgtactgctttaaggggcatcagcaaactaacagaaagtcacttcaatgatcaaataaccacattgtttataagtataaagtttatactccttatttatacttataaataatgtggttgtttgactaaatcgctttctgttaggggactgaattgattgataatattgacaaatatacatctggctctagaaacaaaaggctgaatatttaacagcaaatgcaatcagaaaaatgcatatttattaagtacctgctaactgttgggcttcttggagaatataaacaaataaagaatattagctactaccttgggacacccattatgctctaggctctctctctctatatatatatagcataatgtatttaattctcaaaacaagatgatgatgttattactactcatatccccattctatataaagttggcatagaaatcaagcaactgctcctaaattaacatggccaaaaacagaaactcaggcacatattcaaagtgatctgactttagagtccatggtcttataatccctgtatcacctgcctcaaacaaaccttagcttttacagcatatttggagagcaaaaacttatctaaaaagaaaattaaaagtacaagacagtaaaatgatttagataatgactcagtagaaaaaacactgactccgtatcagaagacctgtatcggggctgcggttaagttagttattgaatctccctgcatctcagttttttgatgtggggagaaagcatatcgtgaactctagtgactggagaaggatgtgatagagaaagctgtatatcttggtggggttccgcaggaaacagtgctcagttctgcttctcagggaggtccacctgcagggcagcaatggatgattgtatcttactgcacacctgctgcctcacttcaagccatagtcacatcattggtagcttgacatcgtaggttgtcagctacataggttgcttccagacaggctgtatagagaaaccacttgggaacagtctgtggaaggaaagaaaaagggattaatttacctgactgcccctttgctggtggagctgctttacctgaacctttgacagtcagtggaactgagagaacctaaaagatttcataaggtgtgtctgaaacactgggaatcaaagaaggttttggagggtgaatgggattcagataagcagattggagagtgaaacctctgctagatacgaggagaagagagtttaggcttttgtctggcaggttctgtgaaggagggtactcaaagaaagatttgcaaattataaacatttgtttcctctttgggactcacacaactcttccctgaaaataaatatttgtgttctttccccaaagtcagacaaaataaaagagatgaatataatatttaacagtcctttctataaattttcctgaattttttgatatgtgtttcctcttgttcagaactgattaacaattgtctgtgcctgtgctttgctgaaagtgtgatctacgttacttggtacagtggccagatttaggtttgtttcctctggtccctcgatcatgtctctcttgagacagtacttcattttcacttcatctctgtctcttttgctttttttcatttttactacattgatgatcttataaggactgataaattaggttttcatcaatccactgattaaatctttgaattttgcctggacaggggtatcagatgttctctgtgtttaactacttatgtacaattactttttttttttttttgagacagggtctcacttagtccaccaggctgtagtgcggtggcacgatcttggcctactgcaacctccacctcccgggctcaagtgattctcccgcctcagcctcctgagtagctgaaattacaggcacgaaccaccatacccgctaatttttgtattttcagtacagacggggtttcaccatattggccagtctggtctcgaactcctgacctcaagtgattcacccaccctggcctcccagtgtgctgggattacaggcatgaaccaccatgcccagccatacaattacttataattaaagttactgacataaaatgatggaaaggacaacctttattttgatttaaatgagcaaactttgtaatttacttgtttgtagattgactttttatgtggtttgttaaaataagaaatttttaaaagatagcttattaaatgacagtgacattagcatagatattacacattaactataataattgggtgcaaaaatcattaaaatgcaatattaatatttaatctaaaacagattccggtgggacattttaccacaatatcagtatttgatctaaaatagattccagtgggagattttacctaaaacttaaattgtgaacaggaagaatttatacccacatttctatttcttatctaactcattttaataaaatcaattttacattttccaaatatcagtaaaattagagaatcaattaaaatttcatggtctacagcattatctttagacagaactggaagcaatactccagttaataatctaactataaaaatagcagtattgctctagtttcagcaataagaaattataattgcccgatgacctgattttttttttttttagtttaagaaatttagctatttctaatcctctttgtcctcaaactttgtacaaagttatggttgataccaaacaaaaaatctggagcatttcttattttccattcacaccttggaatctacatgtacagatctgttttctgtatgtaaataaattaaggattgggtagatattagatttgttatagtgacaaaaaaggatgtgaatgttaatctctattgtattgaaatagtttagttaattatgaacaggtattagttcatacaatgcaggtgctatcgtttggatatggattgtccccactaaaactcatattgaaattttatcttccatgtggcagttttgggaggtggagcctgtttgggccttggggacagatccctccttaatgcattaatgccctccctctgggttgagtgagttcttgctctcttgagaatagatttgttcctgctctcttgggaatagatttgttcctgctagacagcgttttaaaagagtctggcttcctcagtctctctctcttacttcccctcttgccatgtgacctctttgtacacaccagtttctttctgctttttgccatgagttgaagcagcctgagaacctcaccagctgcagctgcccaaccgtgagccttccagccaccagaatcatgagccaaataaaccatttttctttataaattactgagtctcagggagtctgatagagcaacactaaatggactaagacaccggaaaaacgagggtaaaatattccgcattagtctcgatgtagttccttaaagtaacacaaaatctgatgcacatgctgcgggtaaagaagccctccaagtggatgtgatgtgatccttctccttcctggtgttctgttcataatgacccatcaaatagaaggtaataggtacaaagtcaggcaaatgggtaggacatctgttacttttgttttctgtgtaggactacctaccttccctgacagtgggaagattaaaatgtcgcatgttcagctgctctttaaaaatctgccttcaacttatcagttaaacttgaaatatttatacgttattggcttagttttgtacatgctctatattctaaagccactataaaatctacccagtgtcacttaactgtcagacacagcttgttcttctgaattttgactcataatgcattagaggaattgcatggtacaatacaaacgctattaatttttctattagttgaatagtcatactatatctacacatataaatgcctttaaattctaattttacagaacattttaaatgcaaatgctataatcagtgatttaattatctaaacagaatattgaggtttggtaatttggggaaaatttttctatttaattgtgtgaacagttaaaatattctaattaagtggatattagagaataaagacatgagagaaatggcgttatcactaaacttattgaggaaataaggaggaaacataccaacaccgtaagtcaaatgtcagaatttggtgatgccaaaaccaaggagagtctggggactgataaccagagcttagttaaagccacataacatgcttctgagtccagccataggcaagaattttaagaagacattaggcatgagcaacaaacagagtgagaatcagaaatagtaactggagtcttggaagagagaaaatgtcaaatattagtatcagctaagaataagaattagattaatatctagcatttaattaacttttacagcaatcacattattattcctaaaataaaaattagagcattgtagatcaaaaagattaagtagctaagaacacagacaagaggttgcatgaattcacggaagggttttaagcagtgaaacttaatgctgaggacagttttgctggcattagactcctttcgaaaagcccagatatagttctcaggcctctttgttcaaaatgcagtgtgataaaacaatttcttctttccttgtttattcctcatggagttatagatatgcctacattcttaggcaggatgagaaatcagttcattgaaagcctacctattgactgctaatggagtccggtacagtgctaagcattttgaacgatttatatcaattaatcctcatgactctgtgacacaggtaatattagtatttctatgctatagacaaaaaaaaaaaaaaaaaaaggacttgggccattagttaacttggcccagtaacacaaaaatcaaatgttgggattcagattcgatcataagtagtttgtcctcaaagcccaagtttttatccactctgctaattacaccataattgcacaggatggcacaagaaaagaggaaaaacaatccttagtattagcatgaccattattagtacctcacgtgttaagatatctatggttaaaactctcttccagagcaggggaacggatattaagcctgtctttaagatgccacataaactaagaatcttgagaaaatgcacatacatgtacataaatgttgcatcacattttagagagttattagactctgaaggtcagattttaaatcttcaatattaaaggtcattctatgcaaataaaattatacatacatatatacacacatatgtacatgcacatatagcttaaatttatgctgcttttagtaactctgctattagtaaactatattttggaagtgaactaaaacggaacttgctaaaataagtgttttctggtctgaagaaagatatggttagaatctgagccctccgccatctagtgggtaccttgagtcacttattgcttctctttatgcctgtttcctgatttataaaataggggtgcaaacaatacctagcccagaagtttgtcttaagcattcgatgagttgacatttattacacacttactagagggcctgtgcagaaccagctccctataatatgtcatagcctccataaatttataacaatgagttttaatatggaaaagagcacctttaacatctaacactttttattttcgcatccccattgtaacacctaacataccgtttcaaacacagtagacatttagaaagtatttgctgattaagaaggaaaaaatatcttaacattgctccagtttcaatcatgtatttaaactgctgttgaatttttggaagtctcccatcatttcatggtgctcacaaatttccacacatatttttatgactcattatatattagtagtataacttcaaccttaaatcctcatataataatatacatataatatgtaatcatggtattaccttctgcttttttccctgtaactatatgctttgtactaatcattcatgcaaatctctacttttattatcagaatatttttcctgctttttacagatagccaagcttatctattcttctggctgtgtgtgtttttttttaaatgccagagaagcatatatgcaaatgaaggtagaatattttaatgtcgttcattgatatgttattaccaatccttgagataaagtatcttttttgcatattgtaaaagaagaatagaaaaaaatcagtctctctctatgaatgttaccaaaaccatcaattaaaatgttccagttaattcttacatgtgcattttgccttatctgaaaatgccaattgctcagtgccatttgatcttcactgagtgttccttcttttggcttttttaaaatcatttctgctaagacgtgtttagatatgttaaaaaactggaaattcttttatagtttttgtttaattttttcttaataaaattaagacaatgatcaggttgtttaattctgtttatattgtcatgagattaatttttttaccatattttaatatctcattaattaaaggagaaatctaagtgatacattcaaatatctgtactgtttgttatgccataaaatctttagttatgattaaatctttgaatgtctatatcctagatcaacagagagaacttttaaagtttattttaataaatcataaatcaatttggttactagtttggctatttttataaaacatttaaaatgtatgttattattcttttataaattattttcataagatcataagtaagatgtagtcttactttgaagtaaagaaaaaattttcagattaaagtttaatagtaaatagatcagtacttctcaaacttaattgtacatgctagtcactgtatgtactacagtgcatagggtgtcttgtgaaaatgcagtttgattcattaggtctgggataagaccacattttgaggagtaaacacatggaatatctttagggcatctagtgatgactctgctgaaacttcttggaccatataattaacatgcagaattattttactaaacgtaaggcaaagtaatggttctggaaaaagcctgagtactaggataattagatataacttcattctctcctacttagctagttagtctagggcagattttaacttttcttagtttgctctctcagtaccttaaacagtagtaagtacttaagaaatattgatgtgttgattaggatttcatagaaataatcagcctcaatgatggcaatttcaactcgatttagcaaacattgaagacctactgagcctgaaaggggtagtatactcagggtaccactgcacacttgaattattcctttctggaagttatgtgaaaaattatatgaaatatagacattggcattgacttagtggctggaaaactttcttggtggcctttagatatcagcagacctatcatttctgtcatgtgttttttattggccaatagttcaggtttctgtgttgctcaatattcctagttattcctaaatgttaggggtagatgcacccaaaagcttctcacatttacctcttataattcaaatcagataaagaattatatttggcctgagtttggtgcataatagaatagttttgttactctgtcaataatggcataattcaattgttaatgtaaattgggatctagtacactagacatctcagaaattaaataagacattaaatgtctgctatgggagaatactctaagataatgactttaaaaaatctgattatatgccatggaacattctaaattcagatgtggctccttccactcactgataacagaatttggaatctgttattaataataaatccaacgtcagaagctggcttcctgcaaattgtcgttggctggtattctctgtgtttcaaattgagtaattaattatattagctacattttgtgttatacatatattagaaacaacgatatgtttgcaatgcagcaaatactattttgttattgttaatggatatggcatgcatgccaattgtctagcctttcttgcctttaaaactgttgttaaaaattagtatgttgtcacacattttgatacaatcttgactacctactaatgtttttaaaaggttggtaactacatttgtaagatataaaatatggtagcctaaaattggacgaatatttttgtttttacattttttcagtctcctcttattacatttgatggtgaatttttcagggaacaaatctcagggttttttttttttttctgatttcagtggcattgtgctttagactatgctagagtttcagagaaaatttaatatggattattttatgaaagatgggaacttctttggcagatgaacctcctttttgtactctctcttttaggaatattaatattaattcataattaacccatgaagccttattctttctacttcttccttcctctttttgatgggatagccacataataagcatggccctctggccatggaaccatatagatagtttcttcaactcatcagcactggcaaatactgtcgtggttcaacaccccattctgtggccacagaaaatgctgacagaccacgtttaaaaagacacagactaattgtgaaaattagcttgcatttctcctaagccaagttcaatttttgccagtgagttgactttggaaaatacagagtaaatagttgcatttcttattcatcaagcaacttgacattatactaccaagcactgcttttatttttaatatgctttgaaatcgacaatgataattcaagttatagaatgataattatcaatatcgtgtcagaataaaagcaaatgccatttactgtaatatgtagactcagagatagctcacaatgaagaacagaataataggaaaggaaaaaattcatattatcacatacacccatgattttagtaaagttttaaaataaaaataagcacttatgatttaccagtgttgaagagccttacttctattaatgatgtattttctttttagaatatttctcttggaggatggcagcctcaagatatataatattaccaggtcagatgctggatcatatacatgcatagccacaaatcagtttggcactgcaaagaacactggcagcctcattgtaaaaggtatcatattatcttcatttgtgcttgatgaacattgtaaatatgcaggcatattatgacttgtgttatggtgtcaaacctgtaccatattgtgtatgtaaaattgttgatttcacaagttatctaagagatccattcccgtactcattaataacatgcacactttgccagtgggataccatggtagatgtgaatactttggcaattgaaaatgctgtcagagtgtcattcgagttaaaacctacacctaaattatttggctttttacataagccttaatgttaggggccatggacgttttgataaagtcactggataacatttttttggtcaaatatctttcagaatctttatttttatttgaaatatttacatgtatataaggctaccaaatacataactggctaatttgtttatataactccaggtacaaaactaatgaaatgcagggtcacaacctttagtaagcagttcttttcaaagagaaaaaattaaaatctgtgtgaatcattattatattttcatcacagtaagcagataaactcatacaatttatagagataaattctatactttacttttaagatttctaaatcagtatcaatccaaatgttcctacatttatcaccaaggacataattaatattagaagtatctattccctttccttgctgctttattttgttgaatctcagctcataaaactagtgtgtttactggaagctgtatcacttctatcatttcattgcctcctggatgataaaaatggctctcttgataaagcagtttaagcagctaattaagcccaaatgattaaaatcagcatttggtgctttctcatcttttccattaaaataaatatattcaataaaaagtagttagctgctacacttcaaccatcctttaaaatatctcaaggaaaataaacacccacctttgagcctggaagatatttctgccaacttgtctcaagcgtattacattatgacgacaattgtctgaagtattctggggaaatgtgactgataaaacttggtgtgtcaaaatccaaccagtatggcatattttgaaaaacttctcttccttaagattgtattgtcatcaatttttaagacagagatggacttaagtgtttcaagatagatgttatggctatatttaggaacagactatttctccagcaaatttttggcaatactcagacactgaaaaatgtgaatgctttatatttggaaaagtaacaagttcattaacgggaaaaaaagatatttattatatcatttcaaattaagaaggtgtaggtagtatgcaaattttattacagcagaagattaaaatgtggtgaaggataaaaaggcattttgcagttaaatcttctaggtatggaaaaatccagagggcattaaaacgtgaaatagaagggatagaaaacatcagcagtagcaatgtagtttttaaaagaaagtttctttagaatactggtgatctgggaggagggccaatggttttgctgttaaaatacaatgatggggattccttcactctggaggataagaaaaacacaagttaatggtagattgaactgaatgaataggcactcttcctccagtgtttcttaaactttgacatcataatattcacagtccactaataactgatgaaagaaaaataaaaggtgacggctaacaaaaatactaactgagaaactcggaagccactggactgcattctggatgtaacatttgcatatttcagatgtgtaatatagccatgttttctgcaagttaggttcctagtacttatgatagaaataagtttatctacactttcaagtattccataaatctaaccataatccccagctactctgctctttccataggtaaaacaataattaatcaagatagctcagttaacaaaaaaaaaaaaaaaagcctgacttacatttttgtttgttcatttctagtgctctttgctgaggttgttgaaacaaaattatcccactaggcattccttgttaccttaatcagttccactctttcttcttctgtaccactttttatcttcttacgaactgtataactgacttacttattatggttttttttcttgtcttttcttcccttctagaacagaagcataaagagggcagggatttttgttttaatcaatgatgaatcataaatcctagaacattgctgggaactgtatgtgcccagtaaatatttattgatttaataaaatgttattatcttatgcagcttagttcatagggatatttttcatactggcttccttgctctaaaatcggacagttttcaatttttcagggtctgagcttcttaggacactttgcaaaaaaagaacatcaaagaaaaaaaccaacctttttacatgcattcactttctaattgtagggtttgtaatcttttatttctgacagacatcgatcacctcactctcctaagggggtacaagcctgaacctacatcgaaatccaaaaattcgtgaagagaattcattgttttggtatttctagcacagtacaggagaataactcacatatacaaaaagggtacatgataacataactgatgtcactatgcctgattatcaagttactttcatgcatttacacctaataatgggaaggaaattttgctatattttaaccttcatgacacatccacatcccattttaagtggactttggggtcttttgcttctttgtcattaacaagaactatcctatgcaatataaacatgtacatacttaaccacacaaatacatataaataaaataaacacaaaatgtgtgtacagtatgaagaaaaacagccttagaaagttgctttattatttatctgtaatgtttaatctttatgaaattgtgtgactgtcatacaagcacagttctaagtctattattaccatgtcctcttaactagactgttatctctaattccctttcatataaaaatgttgaagacatcactgccaaggaattattattttacaacctacaaatttgaagcctagcataggaaaaaattataatagtgtacatcaattcaaccattttcttgactattgggtgtatagtcatctggttgtttcttaagatggcttaatagttgtgtatatatgtatgtgtattttctcatcagtaatattcatatgattgctgttacagaatcaaatataattttgtttctcaagccaaaatcagtgtatagtgaccttaagagtaatagagtgttaaggagcaaatgagaaatctcagtaaagctgataaaacaatcatctccctttgaatttacttatcagcctctgtcatgcaagaaatgttgttgttagataacatggaaaagataatagttacaagagtgagatattttccagcttagtttttagctgatatggcttatctctgttaagaggattctgaagttatctgcactgtatgttggaaatttctatttcactaatacagcaggataaggcgattttccattcaaacattgtgagtgcaattagcagcagcttttccagcgcctcagaagatgcccagtataatttaaggacatgtttcagaggcacaaacaaggaatcaagaggaaagagagtttacgtgttttcattttggaggactgagattaaaattacaatgtgtacatacactaagaggtatatgaaaatcacataaaaggagaaattatttgatctggcatttggaaaattattaaaaagcagagtaacagcaggctataaaaatgatcttgtttgcaggcaacatttgtttttgtttccccactggagaagttttggatgttcaattataggcctcattgcttcagtgttattttcaactgaaatgtcggaacttggaaaagcatatctaatgtgcaaattaagtttattgctgctcatttagttgtttattcttcgtgatagaagtctttattataccagcattacagagtggcctatccattttctccagcagaatgatacgggtctaagtttactaagagaaatgcccaagatatgtagataattggaggcttcgtggctctagaaggcagtttgaaggatttgaggtatcaagctcagctttattgacaagcccagtttgattgagcagaccaaaagtacactttcagagaaatgacaagatgtattggaatacatttgtcatatcgtagtacttgaaaacaccagagaagtctccagcagcactaaaatctccccaaaaatgttcagttccacacgccactttcctacacagaatgactgaaagcatttcaacagaatgaacatttgatttaaaaattagtgatggtaaaaattactttcaaggtgagaaaatatataaggagttattatactggtcagatgaaaaaatttcctgttccaatattgaaagtgatgctgcgtgaattattgaaacgtgaatactacaatctcttcaagtaaaaatgtaaaaacaagcaaaaacacgcatcaatttaagcaagcccactaagatcaatgttgtcttggtcttcatgaaaatttagttcacaatcttttttaaaatgcagcatatgtcactcagattaaattaccacatatgacatatagctgtgttttttcttaatgtatattttacaaaatataatgtaaaggatagatgttaatacagcataggttttaccacttttttcaagatatttttactgcatagtttaaacctattattggtcaaagttttgtttaattttgataaaaatagggggtgtatagctagtggtttatgccagttgaaggagaccagacacagaagagtatagaactcttactaaagtggtcaatacacagcctctggaattatattaacctgccattactaactaacgtggaacttgacgacttagtttttatggttattcatcttgttttctttattattattattcattactatttgttaaatacattctctgtcctaggcaccatgataggttctttgtgtatatcatctcatttcaactttcagagtaatgctttgaagcagatattattatctcaattttatacaagggagattgaggaataggttgctaaaaccacttgcccaaggtccctgcattagtaagtggcagaactttagctttccttcttttccatcttccaacaaatgtacatattaaaaaatgcatgagacaattttacatcgcattgttcaaagtctagcaggaataaaagtatagtaacatgcagatattagtacttcctcctaaataccgcagccttcattcattagagtgcaattttatatgtacatttttatatgtaaaaattcatttgagtgcaatatttatgtgcatttacattttattatatgtaaattttacataaatgcacatttatgtaaatgcacatttatgtaaaatttacatataataaaatacataaattttaatgtatattcactaaattttgaaaatggcatttgtaacccaaaacacacaagatatagaacatcattatcatccaacatctagaactttttttatgtcacttaatccttgttcctactacactcctagaagcagctactgtaataattttctcaccatagatttcattcaaatgctaccttatattgtgtattcttttgtgtttggtgtcattcatacagtataaaccactagctatccatctcctatttttattaaaataaaaaaacacttcaaccgatacgtttattctgcaggtaactaaatgcatatatacatgtatgtatatataaatctcaaactattaagtctttttgatctttagtttcctgcccaaacctgcaaacacttgtgctcacttgtttcttgagtttttagttaagaattggaaatttagtaaatttaccttgactctattctgaccgtaaaagaagcaattaggctactcttcttcttaggcattctctctctaaattagctcagtggtcacttatgctctagggccattttttttttttttaggaataaactatgtcattaagatggaaaagacttccccagaagcaagctatgttttcagtctctggatcctgaatactcaagcaagtagttaccaaatgctttcaagtccaaaagaggaatggggttgaagggcgtggaaggggaaaaaataatcacatgaatcaaacttagccttatcctctttttttgggttttattttctcattttgactccctcatcccaacatgaaacgttcagaagaaaatatcatttgtattaacacctattgacaggcacaataaaaatttctactttcatcttctacaaaactacaggctgggtgtggtggctcatgcctgtaatcccagcactttgaaaggctgaggtgggaggattgcttgagaccaggagttcaagaccatggcaagaccttatctctactaaaaataagaaaaattagtaaggcatggtggcatatgcctgttgtcccagctacttgggaagctgagatggaaggatcacttgagctcagaaattcaagattgcagtgagctatgatcatgccactgtactccagcctaggcaatacagcaagatcctgtcccccaaaacaaaaaaggtacagaagtcttctattgtataattcgctacagccagcatgaagttactattggagaatagtctgaatgaacactatctatttataagaaatataaatatgatgccataaatatgtagtcactgcctattatgtactaatagctttgaaacagagtagttgtcatatctaatttattacacagaatctacagagcatgttctgtttaaatagatgtcaggccctgctttgactatttgttaatataaaagatctgtgtttacattttacaatattatttgctagggaaatagggtaacattgcatgttttctcatttagacatctcaacttttagacaatgctttctctagactggtttttcacttgtttcttttaatctggggttctcagtagtcttttaatatttattccaaaccatttaaatgttgaagtagtaaataaatgagtaatggtacctgaaggtaaattggaatatattgaccatgattactttatgcattgaaattaaattttactctgtggtgaaatatgataaatgctgcatgtagattttaatctgtagatacacgtgtgagcagataatcatgcacttgtctaagaggatataaaacattttagacttacggattgtatttgcaaaaaggaaaagcttattaactaaagactaaaaacaactcctttatttctggcttgctacacctggagaaatgaagaccccatcacaccgatttccttgttcgtttgcctgcttttctctgtccaaggtttatttcagagtattagctttgattttcctgtgtttgctttcccttcttttgttcgtttgcttagttttctacggacttgccaacaattcatttcccaaatctatctcaatagtctcccttcaatatcagcctgccctgtgtgttgacgctccattgcctaactccatgcctttctgtttcttaacatactccttcactttggttgattaaaccttccagtggatttttgagaaataatccaagagatatacaatttttttaatctttcatgtttgaaagtgtctttattctgtgtttacattttattagtggtttagtttgaagtagaattctagactggaagccattatttctcagaaattttgagccgttactgtgctctgaaagcctaaactttgttgatttctaatctgttgtttgtgacaccttttccctcttgttctctagaattctgttttctccaatgtttgacaatttcaagataatgtgtcatgttttaaatctgttatcaactattacactgggcatttggcaggctttgtcgctgtagaaactcatacttcttggtcctaaaatatctttctgaataatttaatattttattccattccttctcctaaaagccctgttatttaaatgttatattttctaaactggtagtctagtttatggttatattcatctatatgtatgtatataaacatacatgtatattctatacacattctatatattctatatacatgtatgtatacacgtattttttttctttttttctctcttagtcttcattttatagctgtacctaccctttgtatctcatccagttttatgtttctaaatattatctataagttaattcccaaactcaaatcaagctaattccagctcagatatttctcttcaatccccaaattcaacagcctattttatcatcttcacttacaaatttactatatcctaaccttgaactcctgattcttactccccaaacttgtttctactgtcttctttctccactatattaatgacagtctgcactgacagttgtttagaccaaatccttgagattatttttaatttttttctttcatttaaaccccatattcaattgccccaaaatggtttcagcttcaaggtacatacagaatctaaccacttctctccgcttcaatgaccaaactttaagccatgccatctctttcccagagtattgctatagcacagaatggctcaaccaggatgattttgtctcccaggggacattggcaaaatatgcaaatatttttggttttcacaactgaagggtctcacccgaccccatccgctgccttgcaccacacacacgctaaacccacaccttgacacacacaagaaaaaattatttggaccaactgttgataaatgttaagcttggaaacccagtaatagcttcaaaagcatttgtcctaattctttgtttcccttctagaagctacaatgttgctattaaaatataggcaagattttgtcactcttaggactgaaatcttctaatggttcttcagtttggttttgttccttttgttcagcattcctactgatgtataatttggaataaggtaagggtgcaatactaattaaatggttttcaatagatgattgaataaacaattagtacatttctatgttaggaatctctacttctgtccaaaattatacttatttctttctctaactgacagcaattatcatactcttcaagctattatctaaaaacctactgataaatggcctaaatatttttaccaatacacttaatctattatgaaacattaataataaaggagaataatctgtcttaactagttgaagtaagcttatcacaccaacctcccactgatgttcaccacaaatattgttaaaatatttaaaaatgaacaaaaacagttttttcaaggaattgtgacaacagccaaggtgtttgcaacatgaggtgcagaagcctggagaaaacaaaagcacagagaggttagccccacattccctgctgtttttcttctcagaaatttgtcaattcctaagcagtataaatcaggaatgaagaaaccaatcagaaagtagaaaacatctcagcagaaattttggtagacttacagtgaaagggagacacaaatagaggttcagaataaaccaaatagaatgaagtctgctaagcagctcaaccttgagtcaggacatctgaaggactatgtcctagtaagaaacaaaacaaaataaaataaaattgaccaggacttaaaatgactaagatccagactcaattcatatcagtttcggaccagcttctggctctttttataattgcatgcttgaaaaagtaaatcttcccggtacaaatataacactataaaatcacttacatttttgatccacaacgtctagcattcaataaaacgttactaggaataactggagctatgaccaaatgaccaaaactcagagaaaaaaacagataatagtaacaggtcacagcgatagaaatattgaagttctcagacaagggctttaaaataattttgattaatatattaaaagatagatgacaagatggagaatttcagaaaggaaatggcatctgttaaaactccaatggaagttctagaactgacaattgcaagtgctaacattaagaacagaatacattgatttaacacaaggatagctataacagaaagaggattagtaaaggggaggatgcgtgaatagaaaatgtctaaactgcagcatggagagagaataaaatgggaaagacagaaagtatcataaggaaaatatggaatatagtgaataacttttaacatatataaaattgttccaaaaggagcagagaggacagaaagaaaattaggcatgagcaatatttgaagaaatatttgccagatactttttaaaaactgaaaatgataagtatccaattcaagaaattatgtgagtcccaattcagacaaatgcaaaggaaagcctagctaagcacacagtagcaaaactaaagggaaaaaaatcagataaaaaagatacattaagtcaaaaaaacaagactagcagttgatataacaaagaaaaaaggaacccagaagaaaatgaaatgacatttttaatgcgctaaagacaataccaataagaattctatccctatttaaaaatccccccaaataaagacaaaataaagatgctttcaaacaaacaaaacctgagagaatccccatcacttaaaaaaataaaaatttcatatatttaaggggtacaacaccttaaatgtttgacctacttatgtgcaataaagtggttactatactaagcaacttaacttatgcatttcctcacatagctgcctcttttgtgtgtgtctctgcgatgagaacacctgaaatctaaactcttggaaagttctcagtatacaatacagtatttatgatacagtatacagatatatatatacacagataactgtatcattgtgctgtgcattctatctctagacttatttgttctacataacaataactttgtacctttgaccagaatcttcccattttcctcacttttgtgctctcagtgaccaccattctagtatctatttgtatgtatttgactttttttgatgccacctataatttagatcatacaggatttttctttctgtgcctggcttacttcacctagcatagttcttccagattcttctatattgttgcaaatggtagtatctccttcttttatagagctgaataatatcccattgtgtacacatgtcacaatttatttatccattcatccactgatggacactaggtgatctccatatcttaactatcatgaatactgctgcaatgaacatgtgagtgcagatattcctttgactattgattttattttctttggatatatatccacaagagggattgctgggttgtatggtatctctatttttaattttagggaaccctccatactgttttccataatagctgtaccaataaatattcccaccaacagtatgtaagagctccctttttccacaccctagataacagtcatctcttgtctttttgacagtagccatcctaacaggtgtgatgtgacatctcatcatggtttagatttgcatttgcctgatgatttatgatgttgagcacattttcacatacctattggctatttgtatgtcttctttggaaaactgtctatttaattcagtttctacagttggaaggaaaaccatgtatatagaggaagtaataaagagcaacggaaaggactaatatcttaatatgtagcgtaatttgagattctgaggaattcattagaaaaaagaccaatttttaaaggtatttatttctagacattgcaagttaactagcaagagaaaatatgagagaattttgtcacctatttgaagtgctatttatatactagtttacttaatattgatttcttagcaacattttctataatgtcatagataaataaaggaagagccccatgtttgtacaggaggaagagtttgataatttttcttacacttttgtctatcctttgagaggagtttataacttcagcaacaccttagcagttattattctgaaaagtgacattgataagggtttcaactgagttgaaggaaaaaaaaaacaaaacaaacaaacaatattttctgtatggtcaggaaagatgaattatacatttaactgccatccccttgcttctaaaaatgtagttagagatcatgaaaggtaagagtgtatttatttggccattgatatagagaagcagtcccatttttaagtgtttaaagaaatcacaataaatggtcctgacataagttttgatgtaattagtcttcatgtctgctggggtccccgtaactaaaatgcattctggaaacatcattggctattatgaaatgtgaatttcagtaaggctattcatcaaaagcgtcacatcatatattctattactcttcttaagaataggactgctagatgaagctgtttttatataataacttttagctcactgacagagattgaaaatggtaaatattaaaattctgtggttttacaaactcttcatgaatgattgtcatttatatttagggcaatcttcaaaaagtggctagttcttatgatttcagaaagtgaatgagaaatgttcctccctattctgtatgtaaatattcactctcccccaacatgttcttccttttattattgaaaattgcaagcacacacagaagtagaggtgatagtataagaaactctcatgtatacatcactcagagtcaatagaaggcaactcttatcaatcttgtttaatctatacactaacctacttccacaactccaattatctggaggcaaatcccaaacctcaataatttcacccacaaatatatcagaatgtatctttaaaagattaaggaatcttctttttaatataacataaaaccagttttcttatggtaacaaattattatttctaaattatttagaattcaaatttccataatagtctcataaatatgtaagcttatatgtgtatgcatgttaaataaaaacacatatattttatatgtgaatatatgacatatttatgttgtgtttaatcctcttcaatcatgaaagcaacatttccggacattgtttctcagaagtccttatataccaagatatacttccatttctatgtacgaacactgtatgtatcaagaaatgttacatggattaaaaatattccatactctaccaaatgtaggaaaccttgaattaaataaaattttaaaaataaataaacttacttttaatgacaaaaaccgcaattacttttgcaccaatccaataaataagaattcctttcatttaggaattctcagagcttttaatatgttaaaatgtttaagaaatgataaaagtggagataatatacagaattaattacagttaaccttgggactccatctttctttcttgaagtattactaaccaggaacacttactggatataaatttttcctaaatccacagtattagagaatttcagacaatatattttatatttgaatgtttcttaaatagaaatttcaggttcaagttttaaaaactaagggaacatttgtcaaagcatggtctctggaataactatatcaaaatcaagtggagaagcctgatgaaaggacgtattcaaggtctagacacactgaatcagtatttctggtgcaatatgaggagctcacgttttgaatgcatgctcaggaaactcttacacatgttaaaattttaaaaccactagatcagacttcctacaaatggctaaggaatatgcaagaagaatagcatgacatgaaatgaaagcgaataagtaaccctttgttttgtttgaaaagacttaaagaatctcaaatttttacaaacgatagagtctagcgtagtcaacaactttcctcctttttaatttgttataattcaggccctaaagatctcaccgatccataaataccgagaagtgtttcagtgtcgatgagcctcgagtaactgcagctactctactggcacatatgcactcttaggaagtgagtagaatataggatctgagtggtttgaagaaatctctcagatgcttgagtttcttaagaatttaaggtgtatttgatgaggaattaatggactgaagcccctcttctttccacaaagtagcatgaacagttttgcatatttcaactgtgcaagcaccaatcttccagtccctgcaagtgtgatttttgtctctgtggggtactcatgttagtgctggggctgaggctgcacatggctgtagaatgaactctttgagagagcaatcaatggcctcatggctattagacagccatctgcacaggatgaggacaggtctgcctgtggtgggtggagaggatacagcagttaaaatgttcttgtccaagcacctcttcacccacacaggaggctactcccaggaggaactatgcatcccctttttctggataataagcatgcttatgtagagctacttcttttcaaatacagtctatttttcacactgcagataatggtatgtcatcatatcactcctctgcttcatacttccaaagtttttaactttttcagcaaaaaatgcatttctaaaatttttaattgatgaatagtaattttgttttatgtatttgtgggatataatgtgatattttgatacatgtttacattgtgtaatgattaaatcaagctagttaacacagccatcacttcacatcctatcatttttttgtgatgagaattaaaatcctcattgggtaattttgaaatatgtattacattaactgtagtcaccatgctgtgccgtaggtctctaaaacttattcctcccatctgaaacttagtacgctgtgaacaacatctcctcattccccatccctccctcccaccagcctctgataaccaccatgctactctttactatgctactctctactatgtaagaatatatttcttagcgtgacatccagagctggtttcatggacatacaatccagtcacacagagccctgtgctgaggaagtccccatgtttgaaatattctgctgtgactgtcttgaaattcttaatcattttacctctcaatttgtgttttgtacatactaaacacaaattgagaggtaaaatgattaagaatttatttgtaacctgtgtgtgcatgagctgctgctgctgctgcttcaccatacccacatgcatatgtggcagctcctgcacacacaagttcaggcttaaagacccagcagtcggcatgcgtgcacagcagttggtgtggtgtgcaggtgtgcacatgcttgcctgggtagtcatagtcctggagtcctgagggcatgggcacatcagaacctgggcctcttaaagggatggagataatggtggtagcagccatagaaacggcagtggatggcagcaaaggctgcaggaagcgacttcaaaagtagtcaacaggaggatccaaggtgggaggccagcttgcccatacctcgccggaggctgtctctgtgggatttgcaaaaatattaactctccatcctgagcaccagaacagaaattgttagtgctcaggcaataaactttgtcaataaattattgcaaaaggaaggcatacacatggacattgcaataaaatccacaggcttagaaatagaaattaaacttaaagattattccagtcaatgataagaacattatttttatatgatgctttggggaaaccaataattgatgagttttgctttgtaattgaagatacaaaaatggaatggtaaaacaggcattttgaactatacgaaaatcatgaagtccctttcaatttcttgtacaacctccacaagttacagtgtatgtcagaggaaacattaagattccattgcatacatttatatttaaaattaaattcaggctttcataaaacagatttgtataaagagttaaatctttttagaaaaatattggtgaagagaatcatcagctctagatatttcaacatttatatttcagtgtataattcatcagaaacttctgaatgttactacagtctataaaacagtcttaatggtttcataaaagttgcatcagagaaagatactttgcaaaataaaaacttatcaaaaagtatttgtgatcttgcatttgccaggagtgactgatgtcactgaagttatatcaattgaaaatgaagttgctaaaaatataaattctgttgatctagtaaacaattgaccagaaaagtaatggagaaaattatataatcaatcaagatataacctcaataaagtattatttattatatcgtataaaattatgacaccaaaatcatgtattttgtaatttgtaagtgtatgtcatcactcatctatgaatcataccctaattttattttataagttataaattattttaaagcgaaaagctttgtatttaatacctttaatgacactttttcctctttttcaaaaaagacaccccacgctttcattttgcacttggacccacaaattatgtagctgaccttaatgacgtttgtggcttatatcctgaccaaggctatcctccagcttcatcttcttcgctttcactcctctattactctgtgtttaatcctttcattttcagcacatggttgcacggagtctgccgatcacagttctttttcacacagtttctctgtgaacgctcttgcctgcgcaggaaatctagtttcctctctctacctgctacctttacccagctcactactacttgccttttacttctcagcgaaaacagttctttctccataaactgatcccctcaggatttgccaaacatttcaaacaagtcacttctagtatatggtgcttatcacacattactgtatagtaactaatatgattggattcatgctagcttccttttgtagacgttcatctctgtgaagcaacactccttatctttttgacttgctgcgggtttttttttttttttttcctcattttcttccctatcttgactccagtacttagcataggattggacatacattacatgctcaataaatattagttacaaatgagttaactagtgaaaaatgtaaccattataagtgatgaaataaacatttcttattcataaagctttcatcattattactgtacaacaatgagctatgtagatagggaataatttgtccaactttgccactatgtggtgtcataaatggaaggacttgctgtcatttttaatgtctgaaaattactttaattgcatgatctaaaactttaaatctgggcagttttgctctgtcaacacatccagttagccaacttatcctcctataaatgtaaataagacatttgtgattttttttttcagagtaactacaaaaggaaaatattttctctagttctaaaaaattttcttggatccctggatatcttttttttttttaaggttcaatcacactttattcatttatgtttttaagttttttaggtcatacatttcctcaattcttcatacattttatttcagtcaattaaattacaaaacaatacaagctttttaaattcaaagtctaaagtatataaagtaataatgattccctctctttctcttacccttcaacttcaccttgctaatgtaacaaacttaataatttaatgtgtatctttttttattttctactagtttattctttgattagaatccaataagatccaaaaaaaagaaagaacccaataagatccatacatggcagttggccaagtttttttttaatctattggtttctcctccatctctcttctttttctttctttttttttaattttattattagtatactttaagttttagggtacatgtgcacaacgtgggaattgaacaatgagaacacatggacacaggaaggggaacatcacacaccggggactattgtggagtgtggggagcggggagggatagcattaagagatatacctaatgctaaatgacgagttaatgggtgcagcacaccaacatggatccctggatatcttttacccttattttggttgcaaatctgtgaagaagccttggaattaagaatgggcatagtccacaaaatcattctttaaatttctccttagacaaaattagaatataaagtgcatgcatctggttaggtgcagtgattaacgcctgtaatctcagcacttgggaggccaagtcaggtggatcacttgatgtcaggagtttgagaccacctggccaacatggtgaaactctgtctctgcaaaaatacaaaaatttacctggcatggtggtgcgtgcctgtaatgccagctactcaggaggctgaggcaggagaatctcttgaatctgggaggcggaggttgcaatgagctaagatggcatcactgcactctagcctgggtgacggagcgagactccatctcaaaaataataataacaaaagtaaaaaaaagtacatgcatctaatataaatatggaaagtattttaaataataaaaaatgaagacatatttgatacagaatgagtttgattttctctattatattcatattcagaactatagcgtgtgtttttattttttcatggctcttttgtcagtatgtaccttaaaaccccaaattattacttcctactttctacttctaaatatttatgaatgaagaaaacaattaaaaatgtttaaatggtcaaataataactaaacattctattggtaaaatgcagttacacattaatcattgtgaacatataaatgcaatctcaatgttagtttggtttcttgagcagaatgaagaaggtagaagaaagtgaagattttagtccatttcttagagagctaaactttatcttataaattacccatggagaaatagattctccatgggtcatttcactatttttaaacttcttcatgtataattttttttttacaataacttgcctaaaacctttattcttaaatgtaaatctttcaaaacaatttattcttggtaagatggtacatatctaaatccaaatatttgtccagggccccttcatagatattgagttgctctttgatgaattctcaactctctggaatcagaactttattataaacgaagtagtcataacgatctacattgtgagtctcttttaatctgaacaaatataggactctcaagtacaactggcacaccctgggattgtcctttgaaattttggtcaatgaaatgctaggtcttgtaaaagaaagattgacatagagaacatttctagagggaaggtttttatgatggatgcataattttaacactggaaaatctgaattattaaagggaaaacttccatcttccctattcatgttgcatctttaacaaaaagaaaattagagctacgtcaaagacagaataattatgttgcattcaccctcttaaatataaacgtatgtctaaatctctatagaaactatggtggtcataatcttagaaacatggtttgtctcatggtatatgaagttaacagagagcatttagagctgttaccagtgtgtcaattgtaatgttatgactaaaatgttagaataaaatataacaaaaacaatgcagtgcatcctgtatatatggaatgccattttttgaggtctacagttttctgtaaactattttcatataaggtgtgaatatatttttaattttagtataagtaataagctacaataataaatacaagacatttaaaaacaggcaaaggaatatttcatactggacattgtagaactccaggttgcatttatataatttcaaatgaatgataaagtattcagaaatatgtattttataaccataggctagcatttcataagctttaaaaaataattttttttctcaacagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagtaagttactgaaattgttaagtgcttaataaaatgaatcaagtcttttacatgaatcaccatttttcatagttactctctccatctttatttgcatggataatcactgactgtttttgaagctacatttgtttttgttttggtttattttgtttcgtgtcttccgtagaaatacttgttttctagatgtaattataataagggggataataaaagggtttagatacaagaaatgacaatgatactagtatatcttttaatttcagagttgttttatgtttcgtatttatccagctgtaacaataaagtaggacttgttatatgggcttacgtttttatccatttctccctttctgtctgcaggaatctgttggggatttgatgataaggaatattcagttacatcattcaggaaaatatctctgcacagtacaaacaaccctagaaagtttatctgcagtagccgatatcattgttagaggtaagcataaatggtgaaaaagtgatcacattgtttcttcacagttacagtgttcatatctaaattgtagacctctgagaaaccacaccatgttatggaagtgagatgtaatcagatagagttttattttttaaaccccaggactccatggtatgggtagtgtgaatacagacatggaactgtgtgaatacagacatggaactgtgtaggatttgactatcatgaacggtcacgcttggcaagcggtgtcagtaactaaaacttagacataccttctgtttataataaatcattcttgtcaatccagagtcaaatccacatgctcctgtagttcttcatattagctgcaattacttgagttagattttaagaggaattaaagatgatggttctcaatctttgagtataggttgatatgcaatcatcctatgcctgatattttctaatctccagaggaagcactactacattaatgtcatttaccatgtaaagggaattaatagaactttatcgctaataatgtgctataaatacattatggtcaatattttacttcctaagcacaacaggtaaaaataaaccatcctagtaccaaattaatgaatgtaagtatctccaatggagtcatgataaaacatttttttcaaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacaggtgagtgacaaaagtgttttgggtcactttaaaaataatattttagtccaataattttaataaatgcaattacattttaaattaataattatataattttgtacaattatttgtttttgagtagtcccaacctaggtgccttagtgtctcattctttttagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcaggtaaagaatcaatgtgttctaaaagtgtggaagatttcgtatgatacagttcttaaaacaaaacaagtatttttatgtgtcttctaatacttttggctcaaaattgtttggcagtaaacgagtggctctcattttcttttatttttacatacacaaggcaaggtgtattttctccaaatagtaggttcaataagaaatgattacctttaagccaacatgtcaaaatcagagttcttaggaaactgtgtttgcatcgcatctattttctagtcaaaattcattagagaatctgtagatttgtatatgcaaatgagttactgcttgtttcattaaaatgttgtagccaggaattaactgagactctgttggtgcagtcagccatatattttcatctatttctcaactctgaactagttgtagcttcactgagcagtagtataaatttttttccatgcaaatgaggtaaatcctaagctcatttaacaggggcactaattgagcattaattggttcactgaacagcagaacgcaagaacctggatcagataccatgccttcttaagctcttttcaatggatcctctttgttccactcaaacttttacatccagggtgacatttaatctgctagctgtatatagcccacaaagttcacattcttattcgatcacataaacaaaggatcacttgtcatggctagcttaatttaacaaacacaaattaccttattaaagtgtgcacaattgtcagaagtcaataaatcaatccttaaactaaagataatgttatatgtttatcatagaattggggctagaaaaaggacatacttgacagtgatatcatccaattaaatcacgctagaagcttacagctgagaggaaatccctttgttttacagaagaggaaaatgaacaccaggatattagctggttgtttgtgacagagctaggttttgaatccaaacctcctgatttttacacccagcattctccataaaagaggatcttaatgtagatgagcaatagattagccaaagaaagtgtgtaaatatagaaattccccggccctcctatataccccctggatcagaatcttcaggtgttgtccatgactctggatatgagctttagtttcaggttgtttgtttacagttgatttatattttggtagctttggacagggttgacagaaactcttacattttcatagcaaagtttgtgtgccaccttctaaccattaatactctcttgtttcagtagcagaatgagactggtgatattcatacccactgagtcaaactctactaactgaaaacctactgagtctctcgtctctccctctctgtctctgacatcatcaaagactaacaacttgttctcaatatggttttaggcttaagtacaattaatttaaaattgaatagggaaaggaattttctatttctcagaacattggaaactttgtagaaagtaaatcaaaatataattcaaaatacttttccttacacagctaaactatgcaaagatcctgagatagtgtgcagttagtcactctaagctgtcaagcactataaattcagcaactctgtaaaatccactctgattcacatcgcttttgatcaaaggcattggaagtcttagaaaataaggtttaggttcacataacttctttctaaaaaattatgaagcttaaagctgacaaagttaagggtaaatttaaatacgaaaaggtatatctgaaaggtgcaattttgaaaaagaacaatcagattatcatatgactattttctggtcatgtttatagagctaaacatcagtatgaaatggaaataaataaaataagcaatctagatttatttaggtggtctatatggtggggaaaaatttgaaatgaggaattaaaacttacatattttaatccctgcctaccaatccccagacatatccaagtgcctcctcaaccaaccacctctcctattgttcagacatggtccagtatagacaatttcatgtaattccacatttaaaaagtataccctgctgatttagcgattatcacagatttaggatacttttgtcattacgtcaagaaaaataatgcttttaaacacttacgcatgtgtaaagtaaaacctcattctcgtgaggcactacaataccatatacacactcagcatttcctcagttttacagtttctatgatctattattcattgtgttagtccttacaaggatacagagttgaagggcatagttttttaaaactcatcaaaattactggtttctgaatcctctaccacagagccttagatcccaagaaataaatagaaagaacctctcccagtcgcattcttgacaggagaaaaacctgactttgcaagtgaaaagttagaagaaaatccctcttcttctctcccgagagatttgagattgtaacgaggagttttaaaacaagaatatttatttacatatttttcagtatttaattttaactggtaaaatatcctgatgactaataaaaggaaaaattagtttagtttgtttattgaaaaaaaataattaatatactgcctcagtaacttgtttacagctcaactgtataattaggcactaaatcagcagtgtcactgtcaccatctgaatggaacatcattttgccaattagtagatgatgcataatgatgtcaaatacccgatgttactcaatttttaattaattttggagccagggtgctcatgtatcaaacacaactgtgtcctctctcttagaaatttggatatgtgtaaacataatttacgttcattaaaaatgcaagactctctcacagtatgcctgtgtgagattttgaaaagtgaaattcaaaaacaaaattcttcctgatgaagacgtactttaataattgccatcccacatttctcttggttatttttagtccctgttgtggcaccagtaaacatccatggaggtggaggaagtcggtctgaactcgtcattacgtgggaggtaattttctgtccaactgagttattttgaagaaaagagatttaactggccagaaagaaactgaaaaacaaaaagatttatttgatcactattgagagcgtaaaaaaatatggtataaaaatacatcatcctgatgatgaattatttagaggaggtattaggaacttttctcatggtgagacagtatgacgaactcagcacaattttctcccaaatacacgaaaaacaacttcagtatctattgagcgtgtgtcagtagcattttcgttatcgcttgatgaattaggcattgtttgatttgttacctgtggcactgttgtattgtgaataagttgagcccagtagactgtaggcaaaaaatagttcttgtcctaaccctgctgttcacctctgatcaactcattcttccctgcatctagatgaaagcttaggcacatggagtagattttgtggtcattcttattacccattaacatacaggctcatttttttaccttattaaaaatttcagtctggtgtgtacacttcaaactggagtataaacgttagaatttagactttcaaccaatttaaagtttctcattttcagtatctcagtgcctcagcctaagaattctatagcgtgaaagggaatacgtggtcagttcaacttctctccattctgctctttaatttatctttccccattcacagtgttacctctggattctccagagctgtagaaggttggtgttggtaggggaggagaaaggaaaaggtctggattgctggtacatttctcgtttgactttggtgtgctctagttatggcaaattatcagacgctgccatttcatagggtagggtttctgcgttttttaatttattttttatctgggagatggccactggatgatcccccaccaaggactcccaactgcaattccttggtgcagacccaactggctgctgaagggtatcagttcctggattttggtggtccatttccagactcttccagtgaatattctctctcttgtaggtggtctttgtggatagagtccccttgaaggctgtccatggatgacccacttgcatgggtttcacatttgtcctcagcagacacataccctgctccatgtttagcggaagtgcaatgcatacccacttagcatctctcttcactctgccaccgtgggctgtctggatctcttccccactttaaatttctcagacatttgtcagttaaatgaacctgcgtcccttatgttccaggaaatgcaaaccaggtgtttcttgctgtagcctacttcacatagctaggctatgagagataactgggaaccagagacgttattctttatggttataaatgacagtgtcagaaactagatgcaattgccctgaaagtcaccctttcctctggatatcttgtttcatgtggacattataggcctagcacagtgcttggaaagtggtccaccctccatgaacacttgttgaatggaaggtagtgttttcagagagttggaactctcagaggccagacagagggggaaaccctattttttcaagcatttacaggatttcaggtgccacacagagcatttcatatcattcagtccccacaataatgctataaggtggttataccactttcaagtaagaaaactgagacttagaaaagtgacatcattgggcagagaagcatttgaacacagggttctctctttctgttcttttactgtatcctgtattacaatcccaattgtcttcatgcactgtgatggctgagggtgggcctgagtccttgagtatatctaccttaagtagtaagttaaccatattatacctactactccaaacatatttcccataaaacactgactttcaaatgagtctacaagagaattgtttgtgagtagtttatttaggtttctatattcatcaaaggccaaataagcattatcatcatagtgtacaggaagttttgcctgacttaataacttattttgttctcctccttggtaagaaattcctacaggctgttgttgcaattgcttgtacacagtctataatgagggcccaaatgctatgcattcattcttaaatagagatgagcatgaattaccaaagaatactgtctttccacgatttataatgttcttttttctttaaggcaaaggtacacaaaccatgacctatgagacaaatttgtctagtttcctgttttgataaataaatccacccatagctacatccattaatgtattgatgctttcttgctgttgcatgagaccatatatcccacaatgcttaaaatatttactatctggtagcaacaatagacgctagcgtctgctagagtgacgagaggaagggcgagggttgaaaaactagctatattaatgggtactgtgctcactacctgggtgacgggatccatcataccccaaacctcagcatcacacagtatatccatgcaacaaacttgcacatgtacccccgaatctaaaataaaagttgaattttttttttaagtttactctctggccctctacagaaaaagcatactaacccctatttttaaaaattaaactaaattaaagccacttcctctgtgtttattttttcttcctgaggaggaggtggggggtggatatctgatatgcagatacttgcagaaagtaaattagtgaaatcggtttcccatttatcactcatatttgacattatgtacaagcagatactgagccaacttcttctggtgcccagcttctttatggaataagttatgtatatttaggagaagattcatacattaggatgaatctgagccaccagaatgcaggtagtaattccttcaatttaatgaactctattaggtagcttctctgttcctatcagtggaatacaaaaatggatgagaaaaggtctgaatgctcagaagcgtagaggacagaatggtcttaacccagcctggaaggaggtcaggaaagacaccatcagaactgagtatatctgaactacgttttgaaaagtgacttggaagtagagaggccaccccaggtcaatgtcactcctgttgtagttgaaatagtacctgttggactttgaaaggcactgcgcgacacaagactgttctaagttcagtcacaatctgccattacgtttcataagtgacaactttaatgattatccttcatttaggctccctgtggtataatctgcctgaactgaactaaatatctttcccgtgttttccccagagccacacaataaatgtagattttttgtttatttgttttgatttggtttgtttccaaaaacctagacataatatcaaatttttagaatatagcaatgggtaattcctttttaagggcatgtttatacattattttatcataatgtgtatactcccaaatacttccaggtttgaggtgcttgtggtgaatgtctcataaatattactataaaattaggtacacaggataaagcactatagagtaagagatacatacctacactgagggttggcacgctttttatttaaagggccagacagtaaaaatattcagtctcgtgggccacatgacctcttttctaatgtctcagtctgcttttgtagctcaaaagagccacataccacttacaaacatataggtgtgggtgtgtctcaaaacctttattttcaaaaccaggctgcatgccagatgtggctagaagtacatagttttgctgattcttagtctgtactaaagatttggttcttacagacactgtggttgagaattacattattagtttatcaattttcatagattttactcccaggagaatttcacaatttctttattttactgaacactgtctccacttaaagaaaactctttttctggccttgttaaataactatatatattttttaatcatttgactctctgttgatgtaagaataaagggaagtatctaaataagtctcttttttcccctctaatctgcatatgttggactcaggtctttcttgagagagcaccatgagaaacactaattgtacttgactaacaaaaacaaaactcccctatttatgtagatgaactgactaagcatcgtgattaaatccgagatgaaagaaacttcagaaatgaatcaaatgctctagcaagtagcatcgattcttataaatctcttccatgccattcaaaattaactggtttacttctagtctccctatgaaaaagaagagaagtgttaatatgaggaaatactttgttgtttccccagatgtccggagcagcacttttcttcctcttttcactttctgtatttgttagactgttccacatggcaagaaatagagaccagctcaggtcatctcgggtaatgggggtttattttaaagctacatgggaagtaatgaggacaggaaaaaagtctcagcaagcaggcaggaaggtcagatgaagaaccggaacatggttcatcactgctctgggcactcgggcacaggagctctaggcaaccatcaacaacccctctgctgatccagccccggcttgaatagtctctcatgcttatgcctcagttcctcccatttcctttacttccagttttctacctggctgccagctaatttggatgccctctctctaatttacagcatctgttttctcttagcttctattgcctcactgttcctgctactccatgttctctactttttgcctgctctgtgtatatctatcattgttttgccacccaccatgtttcatatgcaaactctgtgagaggaattgaccaggtctgttagtcaccgtagagtacagagattctgccctcatagatactcaccaagacggtgcctgtggttctggcgctcgtgaattggtgctcgcatgggttccaagtggcaagtagatagtgtgattgatagaataaatggactcccatgaataaagagaacctctgaaatggagttgtggacatgagggactagaagcactgtgtcctgtcaggtgttgcctttattagtctgtcagaatatttattaaaaaaaaaaaagcaaagcattttccttgggaaaaaccaaataaattccattgatttttcaatacaagtttcttgccatcaggagatatgttggtctaaattcaagtacagattcattttaatttgctaagtttatgtgattgtttacaatttttagtatctgcagagtacagggggaatattaccaatttctattttgctattttagtaattttagatttgaaatgtattttatagaatctgatctttgtgagagttaacagtttattctttcatgtgaggaaaaatgcacacatgtcactaccaatgaagatgtatgcctaaaaaaatgatgggaggtcttttatacttttttaaagaaatattctgtgtcttaaagcatatgttatttcacagtaattccattacacatgtcttacaaaaacttgtttaaaatgttgtgaaaggaaaacatatctagtcttgaaataaatagttaagaagttaatttgtgctgagtttaaaaattcatatcaaaccacatttgagtgtgtatcataaaatcttttaaactgttttattattataatttatgaatgatcaaagaaaaatatataaatatgtaaagcttgttttatatttctatctgaaaacttaaactatttatctgagtatctttaactgggatcatttttctaattggcattccaaataaaagtgttttttaatacatcattaaacagaataaatatccatatttgtctctatggaagaaatgtgaaataatcaataaacattatagtagcttaataaaatatttttgcaaatactcagtgattgatcacattctgcccaagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatggtaagttgtcctcaactctggttttctttgagactctatgcatagtttgtgttcccttgttccattttcaatgaaccactctgctaaagatggttatgtctttctctggatggtagaacctcaactggccccaaggggaacttctctccagagtttttctgcttctgaaatggaggtttcatggaatgctattgcctggaatagaaacactggaagagtgctgggctatgaggtaatccacattaatttcacttttgcttatgaatgtgccaatggacttcgcaatagctcctattcaacagtcctatcctactagcctgttgttagcatatgataatgtgtgtctaaagctaaagcagagaatgaagttgagacagggtaggtgagcccccacattgagaggcttagcctgggatgtttcttgtcctcgctcaagacagaattcgagagtgagccagtggtaaaaaaacaaaaacaaaaacaaaaacaaaaaaaaacagctttattgaggcagcagtgttacagttttgaaattgcttctgcagagcagggctaccccataggcagtgtgctaagagcagcagcttggaagcagttctacactcatatttatacccacttctaattacatgcaaattaatgggtgagttagttattcagaaatttctagaaaaagggtggtaacctccaggccattgccatagaaagggatggtaacttccaggtgttgccatggcagtggtaaactgatacggaactggtggttgtgtcttatggagaggtgctttagcctcttccctgtttcagtcagtcttcaatctggtccacagtaaagtcctgcctcctccctcaaagtaagggaaatctttctaggtaattcaaagcaaacaaattaacacatagtagccatttttaaaggcatacagattcagtaagtaagatgagtaagctctaaagatctgctgtacaactgtgcacacagagtcaacaattatgcattgtacccttaaaatttttcaagaggacagatctcatattaagtgttcttaccacaacatcatttttcaaaagtgatcaggtgattatatgattaattattcaaattgcagtcatttttttttcccttggtaagaggtgaagtctgctcctcaatcatcttacaccatggaagaatttcattgagaaacctgctttgtgaattgcagtataacttggaaagatgtaatcatctcagaaaaggcagttaagtaatgaaaaaaaatacctagattgtcttgaatctgctatttttagtctatgaagaataaggcaaattacatttgtaggccttcatctcacaaagtaaagagacaagaacattttaagggaaagttgttcatcactcaatctttttcaacttgcaaattcagtgattcacaaaatgggtaacataatttatttaactttggatttagaataaatgtataatcctaaacattcttaattttgcctatatatatatatatatatatacacacacacacacgtatacatatacatactatatatacacacatatatatacatatatacacatatatatacatatatatacacatatatatatatatatatatatatacacacacacacacacatatatatatatatatataaccataatcctctgattccaacagaaagttctactctcaggacaggtgtcttttccactccatgccaagaatgccttacctcttatctgaaccctagttacttctcaaatttcatccctagtcgcctcttctctctgagctctactcccatcaattcctgatgtattttgtcaaattcttgtagcatattttttctataccacttctttgcaatgcattctgtgacttattttcacatacactgtggattctaacctcttagctagatgataaggggcttgaaaataggtacttaatttattctctttttttttcaatgtacctaaaacaatgctaatgcaaaggtagggttcagtataaattgaattattaattaacctgtgattcaaataactctgaaaagaaatgccaatagcaagacattataatgaaagtctttgactgattatatacaaatgtgtttttgtctgacttgttatacatcatttgctaaagctggtaacctttagatagctcataaaatactttattttggtaatctaaaaaatcacgttctctaatttccattgtgaatttgcattcatgacttttttcctcataaatattagagaataacaattttgttgttgtataaccattttaattagaaaacgtttttgtcatctatacttctgtcttcttcccatattccttgtggttgtggttgatagttgttggtaaaaaatgattgatagttattggggaacaataaattgcttgttttggtttttaattatcaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcgtaagtatgcatacactccaggaaacaagattcatctgtgaagagcaacctattcctttgcttgatgttcatttcattcccacacctcatttctttactaattggttactttggttagttggtttgtcccttaaatatggatacttgttgaaaccttttggtaacaatcaaggtaattgttttcatatttctggaattccaaaagaggaatattccaagtatatcgatgaaagacagaagagcataatgtttaagactggccctgacgccctccttctaaatgcattcaaaaactgacctcctatccttggaacgttaggtggtatttatctttgagtctcagttgcctacctataaaatgaggaaaaagtcatatttatgttttcataggttttgttcaagattgaaagagattattaataataagtgtccagtacacaccttaatatatgctcagtaaatggtttttttgttttgtcatttgagtccgagtatattcacatgtgatcctacaactgtcagacacctagatctttccttttaggataccttattactacagcttacttggaagtccctgaaatctaagaatgaactcttctgttttgtcttatatcccctgataatcagccaggtgatttcacagaatcagaatctgctacataaaagatgaatgtttttcatcttttggtgattgttgctgcctttattttctgactgagtctggtaatgcacaaatattccataatacgaggcacagcaataaattgggaaaggtctgatcatccgacttagttgttcctgtaagatgatttttttgtggttgaataatatttacatattccttatatattattaatgaacacaaattattcataaaatcagactttttaaaacacatttttttgctctctgaatcctgatgaatgaaagataacaaatatagttgctgaattttgagaaagactaagacaaattcagtgccacttacaaaaatctagtttacctatacatgccgtagtctaattacaccaccatatttggaaagaagagatggttaagaagagtttgaaaataaagttatattaaagttattccccttatgcgtatatatgcgtatatttgtcatgtccaaaagaagttagttaggaaccatctcagagaataggcccttgattaaatagattatccagttatttccacacaaccagatcaactgtcagatattcatgttccaattctgggtacatcattgactcacaacttgaaataggacaaggcattccatttttttgctttcatgttcttatctatttattaaatagaaattatctctgtcctcactccttcccaaattacccatgaagcacaaacaaggtactgattctggaagcatcttagaaaatacaaagtgctgtggaactgcaaaagcctgtggagcaaaaatttttgaaccaaatttcctccagtccacccagttttagacaggctgggctgtgagttattttcaagaatggattagttaacaatgaagttctattccttttcctgttttactcaatgttgactaaatcaatgaagttgttgccagataacttggatgtatgatttgcttctttggtcttcctggagtggtttagcttctttcagctaatctgcaaatccgaatgaaaatctccaatcaatcagcagttttcagattacctagacatttagttctagttgactgagagatgccaaactcacagaaactcttgtgtgtagggggaggagccaagatggccgaataggaacagctccggtctacagctcccagtgaagacgcgtgatttctgcatttccatctgaggtacccggttcatctcactagggggtgccagacagtgggcgcaggtcagtgggtgagcgcaccgtgcgcaagccgaagcagggcgaggcattgcctcacttgggaagcgcaaggggtcagggagttccctttccaagtcaaagaaaggggtgacggacgcacctggaaaattgggtcactcccacccgaatattgcgcttttcggaccagcttaaaaaacggcgcaccacgagattatatcctgcacccggctcggagggtcctacgcccacggaatctcgctgattgctagcacagcagtctgagatcaaactgcaaggcggcagcgaggctgggggaggggcgcccgccattggccaggcttgattaggtaaacaaagcagccaggaagctccaactgggtggagcccaccacagctcaaggaggcctgcctgcaactgtaggctccacctctcggggcagggcacagacaaacaaaaagacagcagtaacgtctgcagagttaaatgtccctgtctgacagctttgaagagagcactggttctcccagcatgcagctggagatctgagaactggcacactgcctcctcaagtgggtccctgacccctgacccccgagcagcctaactgggaggcaccccccagcaggggcacactgacacctcacacggcagggtatgccaacagacctgaagctgagggtcctgtctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctaaaacgcagagcgcctctcctcctccaagggaacgcagttcctcaccagcaacggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatatagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcaagaagggaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaacggcagccagagagaaaggtcgggttaccctcaaagggaagcccatcagactaacagcagatctctcggcagaatctctacaagccagaagagagtgggggccaatattcaacattcttaaagaaaacaatttcaacccagaatttcatatccagccaaactaagcttcataagtgaaggagaaataaaatactttacagacaagcaaatgctgagagattttgtcaccaccaggcctgccctaaaagtgctcctgaaggaagcactaaacatggaaaggaacaaccggtaccagccgctgcaaaatcatgccaaaatgtaaagaccatcaagactaggaagaaactgcatcaactaacgagcaaaatcaccagctaacatcataatatgacaggatcaaattcacacataacaatattaactttaaatgtaaatggactaaatgctctaattaaaagacacagactggcaaattggataaacagtcaagacccatcagtgtgctgtattcaggaaacccatctcacgtgcagagacacacataggctcaaaaggatggaggaagatctactgagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatctatgcacccaatacaggagcacccagattcataaagcaagtcctgagtgacctacaaagagacttagactcccacacattaataatgggagactttaacaacccactgtcaacattagacagatcaatgagacagaaagtcaacaaggatacccaggaattgaactcagctctgcaccaagtggacctaatagacatctacagaactctccaccacaaatcaacagaatatagatttttttcagcaccacaccacacctattccaaaattgaccacatacttggaagtaaagctctcctcagcaaatgtaaaaggacagagattataacaaactatctctcaggccacagtgcaatcaaactagaactcaagattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctggcagaaagaaagaaataactaaaatcagagcacaactgaaggaaatagagacacaaaaaacccttaaaaaattaatgaatccaggagctggttttttgaaaggatcaacaaaattgatagaccgctagcaagactaataaagaaaaagagaagaatcaaatagacacaataaaaaatgataaaggggatatcaccaccaatcccacagaaatacaaactaccatcagagaatactacaaacacctctatgcaaagaaactagaaaatctagaagaaatggataaattcctcgacacatacactctcccaagactaaaccaggaagaagttgaatctctgaatagaccaataacaggagctgaaattgtggcaataatcaatagtttaccaaccaaaaagtccaggaccagatggattcacagccgaattctaccagaggtacaaggaggaactggtaccattccttctgaaactattccaatcaatagaaaaagagggaatcctccctaactcattttaggaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacataattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgagatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagccaccaatgactttcttcacagaattggaaaaaactactttaaagttcatatggaaccaaaaaagagcccgcatcgccaagtcaattctaagccaaaagaacaaagctggaggcatcacactacctgacttcaaactatactacaaggctacagtaaccaaaacagcatggtactggtaccaaaacagagatctagatcaatggaacagaacagagccctcagaaataacgccgcatatctacagctatctgatctttgacaaacctgagaaaaacaagcaatggggaaaggattccctatttaataaatggtgctgggaaaactggctacccatatgtagaaagctgaaactggatcccttccttacaccttatacaaaaatcaattcaagatggattaaagacttaaatgttagacctaaaaccataaaaaccctaaaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatcaagaatctacaatgaactcaaacaaatttacaagaaaaaaacaaacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtgaggtggggggaggggggagggatagcattgggagatatacctaatgctagatgacgagttagtgggtgcagcgcaccagcatggcacatgtatacatatgtaactaacctgcacgttgtgcacatgtaccctaaaacttaaagaagtaaaaaaaaaaaaaaaaaaagaaactcttgtgtgtaattcagtttctatctcaagcaaaatcaagagtgattagaaatgtgtaagaaacaaacattaaaaaaaaaaacacattgtatcatggtagactgacagacattttagtgcagttattgagccaagactcaggtcaacttttattatacataatcccatcaaccagtttaaggtggattgaaacttgaacactgaactaatcatttacctcaggaagagagagatatatccatatgacatatataatacctatacatgttttaaaattcttattgagattttctgtatgatatatacatatatatattcacatctcactactaattttatataaatatataaaagtgagtagccccacactcccttgacctcaagggcagtctttgaagcaccttcttccctgctattcttaagcactgggtggatctgattgcccagatagggcactgcctttccccaaggtcacacagcaatgaagggggacagatggaggagagggggcctagatgtgcaggcagccccacacggtctcattggagtactgagaggcccaggcctcagctacataggagaactgctccttgctgctgggccagtaggtgccctccgtctgcctcatctccggaagcttccgcaccaatagtgccagccccactgccaggaacaagacagccaggaatcagaggaccaagatgatagcagtgacggccccccgaaacagggctccactggagctggagctggtgggtgtaggccaaacaatgctactctcatttgcagaaggggttgatatttgcgcccagggtcgttcccagggacgacagcagcggcaggcccagcgccaggagtagccccaggccgagctgggtgacgggttgacagtgccgaggaaggggcttctggcgcgcgcccctcctacagcatacagggcgggccatgggcacctgcaacggggcacctgacccaggtgtctttgaagtcgctctgtatatattctatatatatatatcagaacatctcagtaataattttttctgtcatctgaatttgctagtttcattgtccatgaaacctaaattaaaagtgttagtttgtgctaaattattctatgtttttaagcagaaacaaatccttgtttttgacactaaattttttcagttgacccaattgatcctacaaatgggttggacagaaattcacatcaaatgctaaagattattggtttgtctgatggttaacgtatgatcaatttgtcaaagagtaggagataaaaattttcgaaaacagttaaattaaccatgagtaatttcacccaagacacaacgttagaatacctctgctaaggaaaaagtgaaataataatcagaaattctaaactgaagattagcgttcctttaagtattcagctttcttaactaaatcaaacaagaaaaacctctgtaattcctagatatctagtttcaatagctcttaaatttgactcttaccagcctgtatgcttcagtgaccctataaaaatagccaacaagcacctgagaataagaagaatatacaagtctccatccctttgcatttaaatacctatccaacctctcattttattactttgacattctacatcacagacattgtgaaagcagaagagtaacttttctattattctattaatggccttaaactcagtgttttaaaacaatataagttgcttatcacacatttttggaggtcaggagttagacaggggtttcactgggtagaaatccagatgtgctcaagggctgcactagctttggaagctccaaaggataatttgtttcctgttttctggcttttggagaccacccatatccctggcttgtgaccctccttaggtttgtgaccccttcctccatgttcaatgccagcaacagtagggtaccttcacatctctgcctctgaccctctgcttctgtcatcacaactcctctaactctcactttcttgcttccctctttcccttgtacggaccctcctgatgacattggagccacctgaatcatccaagattatttcctcatctccagactcttaatcacatttgcaaactccttttccatataaagtaatgtgtccacaggtactggagattaggatgtgatcatgttttgggggatccttattttgcttaccacagtttcaaattattgagcacttctatgtccccagccctgtattaactttatcatactaaatctcacttaattattacaataagtcaaggagtttggtattttaatttctagataggaggacacaaatgcttagaaaggttttgtcatggcctctgttagactgatgagcatgaaatctcttcatcccactaccactgtgctcctttatcaccttcctccctaaccatcccaataatttctctccctgactgtcaaatcctccatctaaacctcaaactgctttgaaatttttcctcctaaaatgccgtcatacttctcttctcttcatcaaatgtcattgtctcctctattccagagaatgtagactaagaaaaaggcaagcaagatctttcacaatgtgtctcaaagctcctttctataacattcctcttctagccctgacatctcaaacttactgatcttctaaagtttaacattcacttacctggcttcatgaaatctctcagcttgtagtacccctgccaggcctatatatggtcaaatggtcttttttctgctctatagcttcccccaaaatttcccctttaatgtatttgcgtttttctaagaattccaataactttggcccattgtgaaacagtgttggaaaaagttggaatgggacttcagagagaattgtggatatggatccctgctcagccatgtactatctgtgtgccagatctaattatttgataactctgaatgcattttctcatctgaaaaatagagatgaagatacttacctctagcgatttctctgagaaccaaaggatataatgtacaccaaggtgacccagaggctgtcatacatcaaggctcagtgcctggtaacatgtgttattatactcctcctttagaggcaatttactttctttgcattttttaaagtaagaaaccacagctactttctttcactttataagtttgttgcagaattttcttttctttaagggtcgtagaaggacatccaaagcatgcatgaaaaacagctttactgaaacattgatgataaccatgattccaggtgctattcctgtatgtaactttgactctccatgtccttgagatgacatcaagattacctctcaatagtggtgactgaaaaaattctgcattcagcactgtcactgtctagatttgtaatctgatatttgatcttccattggaaagtctgaaaaagcagagctcacatttaccaaaatctctgcctgttctaattggctaagctaaagagaagacagaggtattttctttgtttgtttgttttctcacatgatcatccagtcatctactcaagagatagtgcctcccatgagccatgcctagagttagatgctgagggcctaagagcaattaaaccaagcaagatctttgccaaccggcaatttctcttttagagaagaggcaacctaaaacaagaaaaaaagacaaatgaataaaataatcataaattatgaaaagaacagtgaagaaaataaatgagaaactaagatgtacataaggagcatctatatgggataggctatgtattttgatacaaaattaaagataaagaggagttaaaggacaaaagaacttccagacagaaggaacagcatatgccaaacttcttaagtattattgttgctgttgatgatgatgatactagtattattaaacaaatatcagtgattcatctgcaagtaccaaagcctagtggaaatgatggatttccaaaagaaacagaggtactgcaaatatactgtgatccacacagacattacttaaatggaatttagatttacaaggaaagaaagaaaaatatttatgtcaattccaagcagaaaagaaaagtgaaacaaacaaaacactacttatgtggaaagaagtattcagacgcaataactaaaagtgtttgcaaatgttggctcaatttggcccttgacgttgactgactagcactttgtactcgattctttcttgctgcaaatatgcaatcaatccatatttaaacataaaggaagcattaagcttttattttatcttgcacttatgttctttctcttctgcccaaatgtcaaccccatgctgttacttagaggtgtaacataagaagttgtttttgaattgagttcacagtgtgaactacagttgaaaagaaatgccatctacagaaaaattgattacagggaaaccattagaattctgaggggctagtttaatgttgctctgtcatttgattaatagaaaatgatttagtctttggaaattgcctggaaagattttaaaagttagaaaagtgcttgtttgctgagtttaccattgacagacttggtacaaatatcatgacatgtgttttgtgctatccatgtggcagtgttttggtttctcaagatgatagaaattttaattttatcatagatatttgcaatccagtttaatcaactatatcaaaccagaactgttaacagtactcacattaaggtgatggccttctaaagcagctttcagaagttttatttgtcaatatcagacataaaggattgacactggagaaacatccattgataaaaataagaaaggatgtagactaagagatattctaagataattagctgagactctcccattttatctccctttctaaaaacatatcaagcatccaagtaagagcaatattattaaggggaaaacttgaatgtacactaattgtatctaagaagtgaatcatttgcaaacttcagagttggattattagcaacaaaccacttcgaacacaactgaaaaattgattatgtcataacaccacagtggagaactgctactcttggaagagaattaacagttacagggctttttaatatataccactaaccaaatgaggaatatttcatattttatttcatatctcataaattaggagttattcgtttcattttataatgggaaaatccggctcttggaagagattggatacaaattcaagtctctctgacatcaaagcccaactcttctcatctcccagagagcaagagaagtaaaacattctaaataatctgtataattggctattcataccaaggtactcactccgaatgcaactcttctcgttttatgcccacagaaagttgtgcttctgctttggtagatgaggacacaaatgcaaacatgtcaatgacaaagtcattgccaacattgcaaactgctcctttacatagctggaagaaatcaattctgtctcctagccagttgattttttcaatggatttatagtgttgaaaacaatactttttcctaaaacaaacaaaacatccggaaatacataaaacattcagaatccacactgccaatgacactgaagtggtgaatttgtattttctctgtattgattatataatggtaatgttagtgctgaattttaaagaacagagataaaaagaaaggtatcaagagtagactagatattaaaattgcaatatcctgtgagaattttgatattatatcttttatagctgagaaaaagattttaaaaggcactggaggataagttgaggaaggatagttacaaaataattcttgctgccattcagacctttagaaataaatatgttgataagcattataaatgacaagtacgttgtacattgacaagcaaagtaatggatgcttagtaagctaaaagctttcaggcctttaattatgggtttatattgtcaagaaatgtaccaggacatggtcaatccaattggcctgtccatcttataaataggtatggattgctatgagtctgaccacggcaattggtcttgatcataggacaacataatgaatggattggctgtattgtgtcacctatggatctgcccagagcccagtgcataatcaatacagcctgagaagatcaccacagggccctgaacagttttccttagccaccttattgtacagtcatttattcaacgtgtatgaattggatgtctcctatgtgccaggcactgtgctaggggttagtaatacagagttgagtaaggcacttgccctcaagaaatttaaacaaacacataaccaagaataaatgtaaaccaatgtgataaacctataataaaatatgaactaagcctcatgtaagcatacagggaaacatttctctatcacatcccaactggactgtaagtgattgagtgaacaatagtgatatcccagtggaagtggggtggaaagagaatgtatggtaatatatttgagacacctggattcagcaatatgtgaatcttccagtgacacacaggagattaaacagcagttgactcaaaactatgaaagaaatagtttccacttctaccagtgttataatgaattaaatattatgctcactcagcctcacaaattcaaaagagatgccaaaaacatcttgttgggcagttttatctttacttccactttccagatgaattattttatatctctccagtttcaatctcaaaaatagtcatgtggactcagataagcagcaagttgttctgcagaaacactagactgaaagcgctagaccaagattcgtcagctgcatgcttttggataagtgacttcccaacctggattctcgttttcttgtatgtaaaattctctagttggactatatccattactttagaagccagattctaaatctttcatctcttatctcccaccatctctcacgcagacaacattaatttcagaaaactaaaagtcgcagtttggatttaaagttgatgtcctttgggatgatcaatcagtttgtgatgattttccccttttctggcttcccaaaagctccatttattttaaacggcatgcatctttcacattgtccagacacagttgattaagctaagatagacatacgaccaaatgaagtcaatcatcagctttctcaggggaactcaaacttggactatctctgaacagaggaggttttaagtttcaggtgtggtgaacagtcatgatttctgccgtgtgcagtgagaatgacaaagaggtactctctggcaagatgagtatacagcagaccctgcttcaataagcagagtgaagactgtggctttgtgacatttttttctctcctcagactctgctgcaatctgccatgacttataagaaatatccttgataatttactacaaatattttgcttaaaatatcttgagttagttgtgttacagttagaaagctaactaatacaatgttaaaaagtaaagaattttaggaatgaacatctatgtgttgatatatataaaatgtttgcaacttgaatttgccaaacatgctcattgattgatggccaaatggaatcctagataaagagaccctctgtctgtttatatatgataaagtaaacaaactcaacagcaatgattaataaattaatactggacatgcagcaagccattattaattcataagtctgtcacaaaggcattcccaaatgaccagatttgaataaatttgcttactgtgattagaattaatatatttcaaatgacactgaagacattttagctccttctatgcaaatcatcgaagacttattttttcttttcatgttgatgcatcatactttgaccatgagctaattaacattcatttggatctttgattatctctttaaagctccaagccaaccaccagcaaacattgcctggaagctgacaaactctaaattatgcttgaactgggagcatgtaaaaaccatggaaaatgagtctgaagttttggggtacaaggtgagtttttagtttttcctttaatcatatcaattaagttactaaggaatgaaacatgtgacacccaaatggaaaacaaattggatgcatatggaaacactggaatctttttcaaaattattttgaaaataccattgctgctttctaattttccattgaaaatgttttacattccaaggtccagtaatgtattagggaacatcaataaatcaaattccataggatgtaacattttttcttcaagtggcatcccttgctatcataagatgatggcttatgtgcatagtagatgtgatgacaatgagatcaaaaaatatatctaaatagagattttagaacttaggctgcagtatgatgtgatcttttaacaacataaaaggcatctaacaagagtacaatcaagtacccagagcaactcatttccatcagtgacaatggacatcatctcttggcagacatatattcaacatttgaaatgggtccaaactcaacagtgactttccacagcaagctccaatgataatagcctcaagctatttaactaatagggataaatctactctccttccagaggcattggccaaaaaaaaaaacacctctttttcttaacaggagcaatggaatataaggaaaagacatcacttggatatttccatctgaggagtacaacatttatgatgatgtatcttatgtcttacagtgttccagaacagttgtgtgaaccttagaaaagcaacatgtccatgttaacttgatacctcattttattcagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtaagttgagtcaccattgctgtagtagattctgaacctagacagctgcagcatgaaattcagctccatgaaaccttccagttatggcttaaatgttgggtgataagataaattttcaattgtgagcaaaaggtgatgagccatttttttaagttattctccaaaattataacatacactataaatggttttatgcttcctcatttgaaaaccaaaaagagaacaggaaaaaaaatctttgtgtcattagagcataattgtatcactcattctattatcacaaaaatcagaaagatttttcatagattctttcgggtcttttacaacaggaatggcaaatatgaagcacaggtaaatatacaccctttcccatgttcatggcagacatcactaatcaagtgtggctttcataaggagctgagtcacaactttcaagtcctcctcaaaacaattttctaagccaaccaacaccagtcagtcagagttagcaggcaataataatgtatcatttttgcattagaaaaatcacttactcatctgcctgaagctgtgattgagtgcaagtcattagcatccaatgttggccaatcctttaggcagactttgccaatttagggattttccttttgcatttttatacttaaatcagatgtccttggacaaagacacggtaaggcactttctaaaattaaatataatgtgaatgagacaagtataataaaatatgttactagaagagaaatgatagtatgaaattggggttttgaaaaattaatctaacaggcaatactttatctcaaaatatttttgtcttatttttatattttgcaggtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaacacttttgaattttaaaatccgcacatgattacatgaattcctaggtgccacattaacctggggagttgtaactgctgtgtcttttaagttacttatatggagaaaataaataactcccctcaatgatgctgatgatgaatacaaacttggctcctagttaccataactcacatgtacatttttatgtattccagacaatcacttcagtatttaaaatttccaccctacttcaaaataaaatacaattatttgtttatagttgggattctttaaaaatacaaactattccaaagcatggggtgcttttatctctgaatcaagttggaataagaaatctttttactcaagaatatttcaatatacatgatgttcttctcagcccacttttcagaagattcagtcacaataaaggcagaaaaagtattttatggcaaagaaaaataaatgatgggaaatgagcacccacctaaaataatcttctaacaactctggtatatattaagcaattgctcatggcaaagttgaacatttgaactgctgcatgaacaaatctcaggtaattatgacaagttgattgcaatgtatgtggccttatttttataataaaacaatgtggaaacagaattatttgatcaagttttctacactttggtcaaaatattattttttgccaatcttctctgcagctatgaaaacaattctacatgaaccagggtttagaaagattgtgtgggttgacttttctctagggtgagcctgtttcagtcagtgacctcacttcttaggattgtgtagtctggagaaagcagtctgggagaaggtgagattagtgacctggcccatagaatgctatgtaaccaccccccttcctccacaaacagccttgagaggtcagttcctgctgtcagccttctctggctcccagccagtcaggtttgttgtcctttagagctaaatgtgagaaatgctcacgtgacttttatcttcttaacatggtgcaacctcttaattatgttgagaatatttgagctattctcacaaccctcaaatcatacaatcctcaatatgggattttgtcatttgcatgtctgaggtattttagaactctttaaaataccccatgtagtcagcagcagatgaacaatggctttcatagttcagaacttgctccttgcctgaacagtgtgtcaagcacacaatgcaaattaatgagccttattctccccattgccatatgatctgactgtgcttttgtagagcaaaacaaataagcaacaacaaatactatttggcacacccgtgttaacagctgcctggccaagatacatctgaattgaccagagataccagtgctggcacatggtcttaatggtttccttaatttggtaagagacaagatttgtgtcctcctccccaaagaagacattgagggttaaaaatactgtgaggtttttgtttctactaattaagtgaatcagatatacagtcatttgtgtgtgagttcaaaagctaagttagtttttatcaataattcttatatgtttgcagagtactatttagttcatgatttctggaatattaaatgtctgtattcactgtctaacatatctaacatattatttatcttttcatcagttcactaaatttttcagaatatactttggcattaataataagcagcatgggctttggtgcgataggaatctctcctcttagtgaaaacttggacatatttcttttaacatctccatttcactaatatcagaacaatagagtgttatgtacataaggtatttggcatggtgcaaggaacattgtaagttgtcaataaatggagctgctgttatctgctgctatgaattaaatcccaaatgacataagttattacgtttacatatccaatatattatgaaaatagtttcaacctgtgtttatgtcaaaatccaaaccagcttcaagaaaaatgaattgatcacctactctccatactacatggcactcaaggatgaaaacagtggtgattctaataacctgtttcagggaaatgttctacatgatgtgtatactcctctgacattcaagaaggatttccagtgcatccctgtattgactgagtagactgctgttataaacatgatatgtcatttccatacttcctacaaaaaagggagataatgtgattgtacctggaaatggctggagaaggaaccagaaataaggtttaggagactcaacacagtggaaataccactttaaagctatggactgcctagatcgtgtagagttcaaacacagcttcatttttttctcttttgttcacactctaatcctccatgctcagtgtctcttttctatctatacagcagggggtgaggagggcatggctgctgtctttaaaaacaaatgcagatggtgagggatgacctggaacctatatggattctaaatgtaataacataattattacttctcataagtaaatctagtatttttatacttctatgtatgtcagtcttgagatgcaacatggagtacacactcctgtattagtccattttcatactgctatgaagaaatacctgagattgggtaatttataaagaaaaagaggtttaatggactcacagcaccacatgactgggaaggcctcataatcatggtgaaaggtgaaggaggagcaaagacacatcatacatggcagcaggcaagagagtgtgtatagggaaactaccctttataataccatcagatctcatgagacttattcactatcatgagaacagaaaaaaaaaaaaccacccccatgattcaattacctcccaccaggtccctcccatgacatgtggggattaggattatgagagctacaagtcaaaatgagattttggtgggaacacagccaaaccacatcaactccctgtgtacaattattacttaatgtgctatagaactacatattgaattcaggagatattttgttctagacaatcacatctttgttgaggtcaatacttgcattaggattctccagagaaacagagccaatagggtgtgtgtgtgtgtgtgtgtgtgtgtgtgtgtttgtggagagagaaagaaatatattacaaggaactgactcatgtgattatggagactgagaagtccaaatgcaagagagcctttgatacagttccagactgagctgaaggctaagaaccaggagggccaatagtgtaaattccagtcggagtccaaatccaaaggcaggatgaaacttacttataatctagctcaaagacaatcaggcaaagaagaataattgtttcttactcaggcttcttgtctattcaggccttcaccagattggatgatgcccacctgcaatgaggagtacaatctgccctactccatctaccaattaaatgtattaatctcatccgcaaaatccatcacagacacagctagaatgtgtaatcaaatatctgggcaccaaatggcccagtggagctgacacataaaattaactatcacagtattctttgggctgatattaaataattcaattctgctttcatcagcttttggaatgaaattatttaaatgctcctctcaatttattcatttgtaaaatcatatgttgggatgacaagatctcagagttcttttaaaactctataattttgtactaatgtgcataatgtgtgacttctttgggtataagacagtatttcagaaaccttcacaacccacacatactctacagtcctttccctttttttcccctgtgtttttaccagtcgttccgtgccttttaaactggagtttacattactaaaattgagcatgctttttcaaactacaaaagaccctcagagtttctaacccgtctctgcactccattgagaatcactggtgtattgcagtggttcccaagggcaggactataatgaagttttcactgttcagtgaaaaaaataagaaaaacatgtagagtttggtgagctattcataatgaataatttgtgaaatatggctttcctgcactgtgaaatgctcattctttggggaaacaaagttgagaatggatcacagtttgttttacctgctctgttttaaaataatttacttgggaaaagagtagattactttatatcaagttcaattatttttattattaaaaatgtttatcttctaaggaaaatgaaaagttgaaaaccactggtgttgtcatctttttaatatttctttaatctcataaccattaaattagcaatttgactttgtgtgttgaactgtagtttatatgccaaaacaccaaggttctgagttctatagaattattgtttacttatataaatatttatatttacttataaatttacttatatgaatattaatttacttatataattatattaatttacttattaatttacttatataaattacttatatacatttacttatataaatctaggaaatatggcctaccacttataacaaaacatgaatataattagattgcaagaaaaatagaatgtcaaaatcctgacttttttaatatcttaaaatatggaaattatttgctttccacttttctatgttaaaaattatttcatgaaattaaatatagttagctgttaggctttctttaatgtatttacaaatgattttagcaaaataattttattttagcaaaataatttttattgaaagatacatttatttcttcagtttttttcaaatattattgttcttaacagtgcttggtgtggtcctgggcagagaatgatgcttaaaacatgtatttgctttctggactgatttatacagccaactgttggcaatttgttttcccttggtttccttaataaaataagggccaggcaaggtggcttatgcttgtaaactcccagtagtttgggaggccaaggctggtggatcacctgaggtcaagagtttgggaccagcctgaccaacatggtgaaactccatctctactaaaaatacaaattattagccaggcgtggtgcacatgcctgtaatcccaactactctggaggctgaggcaggagaatcgcttgaacccgggaggaggaggttgcagtgagctgagatcgtgcctaaactccggattttggtgggtaaataatatatctctgaaataaataaaataaataaaaataaaatccttcgaatattgtcatttgaaaaaacatcagaaatgctggtatgttgctattttaaaacacatactttaaaatctagttagatgtgccttagaagatccttattttgtttggagtaaagctctggaggaaagctcacgcgatgactctttaaataaagatagcaagttgcagctcaatgagagtgaaaagaaatcttgatgtaaagtgttttgttccctacacccattaaagagaaggagtaagctaggctaaaatgtttgtgggtatatcatgttattcctggaactgaatgctctgttggatagaatcctattcttaagcagtgattaattaatgtttataaatcacttcaaagatggaaagcattgtataaagtctaatcatttctattatagtgatttttttccaagaagtatattgactttttgcaatagcagtttgaaaaagcatgcatttgtgactgaggccaggtatcatgcctggaggaaaatagtaattggaaagtttgaaaggtaataattctgagatactgaaaatttaggtgaatttataatagcagactattataaattagtccagtctgcatggactaaataattttaattcaaacgtgaagtaatctacatctattcatgacagttttcagcctgtgaaataaatgtcatagcaacagactgtgttcctgaaatgatatatacctgtaacaaacctcaggtaatctcaggggctttcatagtaacaataatgagtttagggaacttttattacctgtaactgcagtagttataaaaccccccaaaactaaaactaacttggaacagattcattttagcctatttttgttgacagaaagcgtaattagatatattactggccttttttccttatctgtgtaaaagtgaaaatgttgtaatttaggcatcaaaattactgttgtatttagacttgcaaacatactgagatattttcatcttctaaattcttaaaagaatagagtctatatatatatatatatatatatatatatatatatatatatatatatttttttttttttttttttttttttttttttgagacagagtcttcctctgtcacccaggctggagttcagtggcatggtctcggctcactgcaacctgtgcctcccaggatcaaggaattctcctgcctcagcctccccagtagctgagattacaggcacgcaccaccacgcccagctaatttttgtatttttttagtagagatggggtttcactatgctagctaggctggtctcaaacttctgacctcaggtaatctactcatctcagccttccaagtgctgggattacagatgtgagccaccgcccctggccgagtctacaattttctaaaagagattcctaagtccgaggacatggctcaggttattttgagtaatgtttggactcacataatatttcaaactagatgacagttgaaaaaagactgtaactagttaaggaaaatctgaaaacccacaacttgttggtgtcaataggtagacagtactcgagaggctgaggctggaagatgactggatctcaggagttcaaggctgcagtgagctatgatcacgccactgcacgccagcctgggcaacagagcaagactatgtctcaaagaaaaaattgacagaatggaaattaatattcatttaatatctgttgataacaactaagataccagatttttctacctgaaattgatattcttcatcagaaaacttcatgccttgtattatatcatgttacattaggttgccttacaccatattttattatttaattatcatatgtctcattttgttttagaaaatgaataatgagttccagaggcgatggaccttatctttgcatttccccttgcatccatcacacccagaagagtacctgacatccagtagttgctcaacacatatgttttcaatgaatatacaaacaaaagaaagtgttgagtgtgcattacttaataaaatctcattgccactcctggaaaagtggcaaagctaacctaaagaattttgtcttttgtaaagctttcatattaaaatattatattgtttttgccttattatttttaataatttatcatgggggatttaacacacttttaaacatttttatcatcttgttattattgctcttttttggggtgtctttacttgggggcttttattaattttattttattttattttattttactttaagttctgggatacatgtgctgaacgtgcaggtttgttacataggtatacatgtgccatggtggtttgctgcacccatcaacccatcatctaggtttcaagccccgcatgcattaggtatttgtcctaaggctctccctccccttgtcccccacccccaacaggccctggtgtgtgatgttcccctccctgtgtccatgtgttctcattgttcagctcccacttatgagtgagaacatgcggtatttggttttctgtccctgtgttactttgctaaggctgattgtaaaacagtataattgaatatgacatacagttgatgcagcactctctgcatataaaatattttaattttttaaagctttctaagattaaaataaattttaagggtaatgcttttttaacagaaaataccatgtaattttatgagagtttcttttccttcccctcaaagatttttaaaagacaattctcaaaatttgtataaacatggctattagaattgcataaccaagccagagagcaacatccatggtgtcacagaagccatgaggatcattccaaggtctaagttgcaattattttccctgcagccgaattaactaaagtctatacccttgatcatacacataacaaaatgtaataatcttgtcatgctacaatattaaatccatatattcagccaggaagatatttttagttggcagatataacacaaacttatgacttcccctttttaggtgctacttctttaggtcatactgtaagattcactcagttttatttccaaaagctcaaaataactgatggatttgctgaaaatttcagagaaaaaatagttctttggcattaaggaagtggcaaactttcagtacaaggtcaaacaggttagatgtcatcagtgcctctttacttaaagatgaaaacagctgtcaatgtttagatgtcagatttcatgtaaatctcactgtccttgaaccactctcagtctgccttccttcatggcactaagctggtgaactagtgagtaagtcttctcttcgagagggagcattcttctctttaccatgctcctttcccagctttcataatccatttatgaacctatctggcccttttagacatttgagttttgacccttgttatatatgatgcaatgtacctagaagacaatattttatggagtcattgttttttacaccatattaccttatgctcatttatatgaacacctcatttcagctgtcatgaactatgagcatttaatgtaagaaagttgaacatttacataacaagaaaaataaaattataatgataaggaattcatcttgtaaaaatatgtatttctttttacattggggtcagaaacatggcaactactcatggaatagatacattcacatttataattgatcaaatctgtcaagaaaacattacttgtttaccatgttctatgcattgcacttgactctacgaaaaaaaaaaaaaaaaaaagcagtgaagaagagaaacatgccaccgaggtgaggagcaggtaataattaagccaactcttctcacttcaaaacaacaatcacctgttatgataagtgctgaggaaaaacaaggaagatgctctgatagaggataaaacatggggccagatgggtaccccaaactggattggcagatggctattcttagagaaatatcatttacagagagacttgaatgatgcaaaaggtaggcatgttaaaaacggagaaaaaagtattccagacagaaaaagaaaaaaagtctgcaaatgccttgaggagaggaagagcttggtatgttctagttactcaaggaagtctggtgtggatggaagatggagctgaaaggagactgaggcatgagttcacagagccaactggaacctggtgatcctgaaagttccaggtcttcagaagtaacttggatttaggttttaaacattacttatgttttaagaagatcactctggttactgtgtggtaagtggattgccatgtgtcaaggagagaaacgaagattctaatagtagtccttgtaatagatcagtggtgggtagactagtttggtggcaggtaatagacctgtagacttgtcaagaattgcccattgatgagatataaggagagtgagggatccctctgaatattttaaagctacctttattttatcacatggagaataccagggaatgatcattcctaggaatacagaagatagggtggtagtcaagattcagtttgggacataagttagagatctctatgagagatctgggtggagttgttaaagagacagatctggcaattagggtcaaggagatctgggtttccccagaagttctagctcttttattaatgagcaacactgacccttgacttggaaggtgacatttgaggtgacctacttcactttatgagtctcaaatttttcttccatataatgcactgctttgttagaggaacacttacattattattagtactcaagcagtataaatgttggacattactattttatgacaagaactctcaaactgcaagatactgagtcagtcattgaaagagttaaattcagattaccatgctggctttattaggcttaagagtgtttttgcctttaagatgttcagaaaaaagttaactataatatacacaatggaatactactcagccataaaaaagaaggaacccttgtaatctgtgacaacatggatgaacctgtaggacgtcttgttaaataagccaggcaccaaaagacaaatatttcatgatctcactaatatgtggaatcttaaaaagttgatctcatagaagcatagagctgaatggtggttatcagaggctggggtgattgtaggggaatgcacgtgaagagttgggaagatgatggtccaaggatacaagctttccattaaataggatgaataagttcaagagatctgttgtaccacaaggtaactacaattagcagcatattgtattcttaaaaatgctaagtgggtataaagtgttctctccacaaaaatgatagttacgtgatgtaatgaatacgctaattaactagatttagttgttccacaatgtatatatcatttaaaacatcatgttgtgcatgataaatgaatctaattttatatgtcaacttacaaattttttaaagatcataaaaaggaattaactggaaaactccattccaaaattaaattggtcattaagattgaatactgataattaattcagaacaaaaagattgttcaggtgtgaccaaattctaaaatgagaaattaacaagttttgttttttatccttgacttgattctaaaaacagagttctcaaactgtaaactcataagcttaaagtaaacttacgatttgctggtccttggcatttttcttttgcacctttagaattttgcttatgctcctttttctgcatggaatgttctctttcctttttctgcctggaatattctctttcccttttctgtgtgaaatattctctttcctttgcctggggagcagcatcttcagctaccagctccagtgccagccactgcactgctgagacttttgctgcagcccactctcctcagaccactctcgcattttactcagtccctggagctccctgtgtccgtctcagtcatagcatttggcatttggtttctcaaccgttggtttcctttcctgcttctctcacttgatggtgaattaattggggattgtaaattcttcagcactgattattatgctgggaacgtagtaggttcctgagatgtatataaggtgattattatgctgggaacgtagtaggttcttgagatgtatataaggtgattattatgctgggaacgtagtaggttcttgagatgtatataaggtgattattatgctgggaacatagtaggttcttgagatgtatataaggaagacaaataggcagagaggaaaaaaaagaaattcaatttttgtttgtttttcagcaagtctgactgtattttgccaatcacatattttagaataaaatgaatcaaaatacaaaaacatagaattgtaatactaaatactctagtttgcctgaaatttttttctaatatttataaaaagcacaccttgaaatatcttgaaataagaagaaaaaaacatattatcaacacaaatcttttattagaacatttcaggcaaactgatgaacaaacattttaagatattacgataagtggctccatatgaattattttctgggatttgtagtacataagacaactctgttggctttgtgacagttaaagaagcaagtttttttctgtaaactgatatttccaggcaaacaaaattccagcactactgcctcctttgtccagaagacaggttaatacccaaaggcaaatgatttaggcattttcatcaccaagatcaatgtttaatttcttcacctaaatagattcctctttacccttttgacctacctacagagtcttgtcattcagcacccctagaatcacagagttgggagggttcttgatgggggggtaattctagctcttcccaagctgcagtctccagacaggatgaaatatgtgtccttcaaggtacagacattcaccagtttatgaataaattgtattgtcttaagaaatctgtcatttagttgttgggacacacgttcactttgttaatagaaatactgctgaaaacagttttttctgcagcctgtaaaagcctatttatcttataatggattgacagtgtagcacttcatggtactcaagaacccaatcttaaaatgaaaccgcgattcaccaacaaagcattttcagagttctggctttgcttatgggaaaaacatcttcttccaacataccagcaacttgacagtagcaacaaggactccacgagcaacaaggactccatgacagcatatatggcgtctctcatggtgtaggacaggaaccccagtaagacaagagtggagaagcagaaacataagatccaggttgtaggaattaaagaactgtaaggaaagaaccttccatcgtgaaactcactttatcaggtgatcagctttcatccacacgccatgttcccactcttctcaggaactttccagtcttatcttcttctgttactttctcttttaataaccttttaaaacccatctagtatcactttactattagctttttgtgttctagcccaagaaaattttattctctcctactgataagctgggcctccatctcaccacagggcctttgcacatgctagtaccttttcctgcaatttctttttgccctcaacaatgtattcttgctcctttcatctggttaattgctattcattctgattaggtaaaactctatatttctccactgcaccaacattattcttccctaacacttatcacagctatagtttatttatttctgttattctccaattaattcctataatttccaaacaatctacaagatccatgaggataggaatcctattgtattgggttgatcattgattgtatccccagtacttaacatagtgctggcacctgggaatctctcagtaaatgggatttatttagaaacaagtgagtcacaattacaataaatatctaattaaataaacataaaattttacattataaaataaaaagttaataacttaatgacaattacttgtatcttctcttaaagactcctgtccataggactcaatttaaagctttaattatgctactttttcctcaaaaccaatagacagtttttctcatgttttctcatcattcttacagcactgaaaataataggaaatcagaaaaatttccattaaattctactttgaatgcctccttcaccttacctccaatctatacttttttcattaacccagttgtattagtctgttctcacactgttaataaagacataactgagactaggtaatttatacagggaagagatttaattgactcaccgttcagtatgattggggaggcctcaggaaatttacagtcatggtggaaagggtagcaaacatgtccttcttcatatggtggcaggaaggagaagtgctgggcaaagaaggggaaagacccttataaaaccatcagatcttgtgagaactcactcacaatcacgagaacacatgagggtaaccaccttcatgattcaattacctcccaccaggtccctcccatgacaagtggggattacgggaaatacaagttaagatgagatttgggtggggacacagcgaacccatatcaccagtggaatgaaggtggcaatatctggcatgcataactctgcctcctggtgatccttagaatccttcttcacacaatcatgcaggcaactactactaattaattttactggcaccatgaaatgaaattgatttacaattccttaaagaggtaaaataaaaagtctcctttctgtttacagcaatataaacttttggggaattgtgatgagaacttactttctaattattggcatttctccagctccacccatacattaagaacagctttaaattgttccatagttttgttgtaaaaaggtaatcttggaatatccaggtggacccaatgtagtcacaagggtcttaaacgtgagagacagaagatgagtcagaatgagatgatgtgagaaagtccacaggggccactgctggccttgaagatggaggaaggggacacagcccaaggaatgtgtacagcctctagcagctggaaaaggctagaaaatgcattttcttctaaagcctccacaagagatgcaaccctgccaaaacctatattttggccccctgagatcccttttatgtttttgtaagctgttaagtttgtgacacagcagtaataggaagcaaatacagtgagtttaagaaacttgccaagttcacacagtgaatggatggttagaaataaaaccgggcagtgtgttttacttagctatcattttatttaactgtcaatgtaaaaacaaatacgtgcatgcacacacacacacagatgtatatataaacatagcataaatatacatatatatgtatatgcatacataaatgtaatatgtgcatatatccatgtatacacatatatatgcatgtgtcatttccaatgttgtactgcctcactaattttggtaatttgaaaataatacatttctatggtaatacaagagcagagatatactcggtatcaaagtggtactaaatactgtttatacagcctgtttcatgagatgctgaagatgtactgtaaacagtaatacttacacgaaattaaagtctaccagtgttatccttgggctgccaattgattgtggttcatggatttcatttactttgtgtgagtgcatcaatgttcttttaaagcgcagggagagtttacaactataatttttactaatgattgctgataggtttttcatgatttagatatcaggaatcttgaaatcaaaactaatagcaatagacaagaagtgataaacagatacttagaaaggtataaggaaacaagagaagggcgcttcattacaagaatgagcttggggagcaggtgtgaccagagagtgtagaagctgtgctaaaagccaggctttgatgtaacttggaggaagtatttagaacagttagagaatagccacttcctagagccagaaagaagacagatcaacttgtaattccattattttccaggtggatgatactgaaatgtatagttaacctctctgagcttgattcttatctctttaaaaagcacattaatatctaccgcaggaggctgttgtgatgattaagtgagccaatgcatgtaaatcacctaggattggtagatgttcagcaaatattatttcctttcttcctccctgctgtctccattgattctttgctaccatgctttaaggtcatacatcctgaaatttgctgccatcaaaggatataatatagttgtttgcccactttttaaataaagtaggttaaatgaatttattttcttttattataccacctctttgggcctttcttattgaactatgcattatgattctttgaggaacataacattatataatagaaatcacttctcaattttatttttcaacaatttttttcacaggaaattacatgagagaattgacatgagactagttcaacaaaacttatcacaagaagctcaaacttaaagtaaaatcttggaatcaagcatcagaatacatgagtctatagttctatcttcactgttttgtggttgagttgagttcaaaacaaatatgtaatgttttaagaactttgttctacctccgttgtctcttctatgaagagttttgaggatgaaactgcaagcagtatgcaaaagtactatccagagttaaaagctccatgcaagcatgagattattattacgttcttttatcatttgacccactatttgttccacaatgtgaaaggaatatagctgattgctcccaaagaccttggtaggtcaaagtaaagaaaagtgcatattatcaggccagaggccacaaggtgtgagactggatgaaatgaacacaatacaatgatctctgtgagaaaataatttatttcaaaataaatgccctaactctagagagctggtagagtttgggacatgaggtacacaggctcttttaacattttcattgaattttcaagcattgttatgtagaccataataatgcacaaaattcttcagaagaatacctggtctcataacaccctccatcttgttgagaagctacatataggtctcttcttttctctgagattcagtattggaaatgtttagagagatggtgggaggattataaattaacagatttttatagttaaaaacatttccaaaaatgtggtctgtggaatatttaaacctagagaactcttccccccaaaaaaattattccacgatcaatgacatttaggatgcatggctctatcccccctctaggagcttcacaaggcacttgaccaatctaaaaactcctggaagtcctgaagtaatgaaaaagattaccttgttctaatgcaatatgtccacaattatttaatcatgttaaacattatttgcaagaaacttacaaaaatttcaccagataatattccaccaaacctgtgggggaagtgccccatgagataatatcccaggtccccaagtcctctaccattcctggagtgtatatggttccccaggagggtgcaggaaggacttggtgcctctacttctacagccttgagaccttcttttataatagtattggtccgcccccatggagtcagtttgtggctggaagtacagtttgcacgattagtgtgcggaacacagtgtgggctgaacaggctggagggaaaaggctgcttcttggggaccaatttttagaagaaagtgcctcctctgtctcagcccttaccaattcttcttgccagctgtggtgtctgtgtttgcccactccagggggattacacattcattttatgtggcacaagaggctgagaagaaaaattgctggcatatgagacacctgtgacatttggggtaaacacaattacataaagccctggtttatgggcttgtgtcatcactatgggaggatcaccttctccctcctccaatggatgggagacctggctataagcagcagaaggggactttataggctgttagacaggcttgacatgggctctgggggtcttccagtcaggatttgcctacccacgcaaagtgcaaaagagaaataaagcatttaaccagaaaattaagacccaaccaagtcacaagaagttgattgtagcaaaagcaatgtacattggttttttctaataactgttgacacataaatctttaattgctaataatgtattgcttatgcactctgctataccatatatatatatacatatatacatacataatctcatttatgcctcacaataatgctccaaggaaggcatttcttatactggttttacaaatgagaagctgaagctgagagtgaagatacggtttgcccaagttattacatacaggaagatagcagaccagaaattcagatcaggtcgagtcaactacaaaacccatgttctggaaccactaaggtatggactcttcctgttctgcatatcttccttgtgttcctccagatcgattctccacccttctctgcccctctttttgtcctaggaggatgatctgcatggattatttttataagttccattttctctggcttcttgttaaatgtgaccaatagaggtcactggcagggttggagggggttcctttaactgactctattctaccatcattgcttttctcaatgcagctaattctatgtaattttctcgctcatagttctggtaaccactttcttctcttttccctttgaaccaagggttgtgtgttagattgctcacagagatagctgcaattattattttcattgttgtataaatattcttttgtaatgagactttgtttcttctccaatataggagtggagtctatttccccatcccattaattagtggtgttcttatcccttgctttaaccaagagaatgtgacaaaagtgacattttccatacgtaagttccagaaccatggcctcaggaggccttacaatttctgccttttcctttttgaaactttaagatcatcgtataaggaatcccagttacactcgagtatgaatgaccacaagatgggactgccccagctaacagtaaaaacaaaacttcagtgatgtgaatgaggctacctgggacctttcaacccattcaatctgccagatcactgcacttacatgtacaatctcaggccaggctagcaggagggctgcccagatgatcctagcctaaataactaaatcacagaattgtgagcaaataaatgttttaaaacactaagattgggaggtgaggttgttatgcaatagatgactgatacagttgttcaactgtcttatgcttccataagttcattttgttcataaatccccctcaaattatctgatttcatgtctaccacctggaccctggctgatacctccaccatgacagtctgataattaatcgaagacttatttgaaaaaggattaccataggatccatctccccatgctcctgaatccatagacgtgtttctctaggaaatcttaattaatagttatatataatagttacttggtgtctggtgtgttgcttacattatcactgcaaaactggaattaagtattattatcatcctattttacttacaaaaaagcagaaatttggagataaaatacttaattaggtgcagtgctagtaagtaccaggctctgagttcaaacctagatcttcactttactccaacacttatgttctttccacttcgtcaaactgcctcagaaattgaaattttagttctaacagctaaccaaccatagacctcgagcacaaactctgtcaacttaggaatctctggatgtccattccataaaaggtgttttgaagctgtaatttcttctctcagggaataaaggtcagattagtaaaagcatattttgacaccatcaaatgaatgtaacttatttggccttcaaatgtagagatgtcaaatcattggtgtagtttcctaataggtcattgcctaatgtttgtgcagtttcatagtaaatctactctagaaatccatcttgtagacccccaggagtaaaagtagatgttcacaaatagagggggaagtagcctgtgattctttttcactatactttctatatttaacatttacgtttcctgtaagaggctccagagataaagaatttatgttaacataggtctctgagggaatatatcatccgaagtgactctagcagattcctgagtatgacaggagcaatactaacttaaggatttgtgctgaagtaacaggcagcacagagcagatgaaaatatattcttgtgacagagcacggaccacattgttaaaggccagttatagaggctatgatgataatagaaacttttttttcttcctttggagagatagcatagatatggcacagtacatcttaggtttggacgctagttatgatgtcttctcattgtgtggcatgaggcaagtaacttgtaacctacaaatcttgttttctttcactatgaaaagaaagaataacaatgacatcaacttcatatgctattgtgaagattaaatgagacaatgagtgtaaaaacttacttgaatacctagtatataaaataaattaaattgttctttatcattggtgtgcctaacacaacaggggctttacacttattgccccatttggtacttccccattcctctatggtgaatatattgtccatttctgtaactgaggcaagttacctacccaaggccttgctgccagtataggtcaaaattagaacttgctttgtcctctgactaaataaaaatcgatctttttcctccacatattgtttccctgcatcagtctgcctctccctggatggtgcatgcatgtgtgtatgtgtgtttatgtgtgcgtgtttaagtttgtgtgtgtgtctgtgtctgtgtgtgtgtgtgtgtgcccaatccctttcatagaaaaagcacagccatcataccacgcacttggctgggggtggggggtgggaagggggcttgtccaacagaggggatgcatttgtcaaaatccatcctctcctatgtgcagtgaccccccacacattaaaataagagagccactgcaggaagctggttccattcatagcttcagaacagagggaagataattgggctatgtagggagtgagcctatggccttggcctcattagcaacatagtttaatcatcagagccaagccaccacaggtggctgtgccccatgcaagtgttgtgcatttcatttcctgaaaacgtcagtgtctgagaatataaatattacttataatcctgggatgattgtgcaggtactaatggaatggtttcatggtattgattttcaatagctcatttgctataatcagcttaacttcatctgctagaaaacgaacttctaattccagtctgaaacatagtacaagcaaatgattttagcctagtctgccaccaccttgaatcccttatggaagtaggctgggtataaatcttaaataaataaatcaactttagcttttcccagattttcatgatcttgcaagattgattttcttccctttaatctgtttttaataaaagagatattttcctttgagacatggtccataatcttttccatgtgtattatcattctcatagacatcctcttttcaatttcaagagaagcaaggcctcttagaggaaggtagcttttgtgactagccaaatctgcacaaagttggaggaattctaggaagacggatgggcctttggtgtaggttggaaagaacaatgtttaaaaataccctgtctcctccctgagaggtatgataccatgattctctctctttatctaaaggtattagtctaaggaattaaaagccatttttctatgagaagaaaaatgaacaagatatgggaaggtgaactagcagagcaacatatagaaataataataaaaggccttattcagaatgtaaaatacactatactaaaaggtttaccttgattatagcactcaatcattccaagactctgagattgtagctattatcatatccatatcttatagaagtttatagagttacatgaacttcctcaatgtcttgcagctagtgtgaaggagtcaggactcacaccatagcacccatattccagaacccacagctaaccactggattctatgcctatgaggatacataatacttactgtttcaaataactttataatagttttcagttaaaatcttgtctctaggcttttgggcaaagaactttaaaaactctgagcctccattcctccagcttaaaaatggagacagtaggtaactcttaccactgagacaacgtatgtaaaacacatacacacgcatgcacatatatatacccccaaaatactggtgttctgattcccattttacagatgtagaaacagggactcaaagttgtcaatgtgttcaacgttttataaaagcagatgaaagagtcaagactcaaacctaaatctatctgactgcaaaaggtgtggcattacctgggcagcccattgaggaagtgctcggagctcattgagtgggtgaggatcttggcaacctggccagggaggcaatgggagaatgactggatgcctacatgtgactgtgataacctgtgtatggaatcatttgagagaagtatcaattgtcccaaaatgtctaccggagcagtgagggtgaggtaaataattgaaatgtttgttcctgaagatgggtacagtattaagagtttctaatgatttcttataagctcctgtaactttaggattttttgtttgatgatgtacttgaggggaatgtgacatcatctgtgtgacgtgatcaatgcagtagatgaaatgagtatttaaatacctgacttaacctgaagcaggataattgttaaaccagaggtgagaacacagattgagaaggtgaccatctcaaccttggaaatttgaacaagtattcccagaggaagaaacatttgactcaggacttaaaacgtgtaagagttttacaaagaaggtattaaataagagaaagggaaaaaagaaaaatgatgtagtacattctggtcagtcaacaaaacatacttatctaaaagctatgaagatccttataaattaaaggcacagaaagaaatgctttatattggtaaaactctatattttggagggaataacactttaattttcaaagtgctttcatttatattaactcatctgattcatacaaccctgtatatagaaggaaataatgtttggtaagggaattgggaaattatttaaatgagttgatcatcaaacaaataagttccaaagctgaactaggacccaaaacctttacatcttgatctactgctccaactagatgcagtataaacagggtgtttacatgtttaatactaggagcaagggcagtgccatacttttggaaatagtaagaaagaaataatgcgcttgtagatctttaatgctaagaaaaagaatctcctatggcatgagattgaggacttttagaagcaaagaggtgaaaagtgagaagtctttatttcagaagcatcatataacgaatgttcatagtcaagagataaataaattattcattattctctctgagagaaaatcaaaggactgattttgaaatattagacatttgtagcagtagacatttgtatctagtgtccactatgataatctttctaatttattttcaacactacactcagaaatatagattcctgattatcagcaagtagcaaaatttcttcaggtcctggctgtttcttgtgttgtattgttggtttccagatttctaagtcaatctgaaggttttttctaagtaacacgacttgcatcgtaagtacttttttagtaaaaagttgtagtaaagagttactggtcttgcattagatataaccactttatattagttttggttatcccaagcaaactgcttgacttctgcctctctctctctgtctctctctcttttatttttttctttttgagacagtctcactctgttacccaggctggagagcagtggtgttatctcagttcacggtagcctaaacctcacagcctcaagcaatcctccctcctcagtctcccgagtaactgggattacagaagcacaccaccgtgctaggctaattttcaaaaaaatcttttgtaaagacggagtttcactatgttgcccaggctggtctcaaactcctgggctcaagcaattctcctgcctcagcttcccaaagcactgggattacaggcatgagccattgcacccaggctgttttctctattttatagctaaccccaatactaataacagctaaaattaattgagcacttactttgtagcatgtattgttttaaacattaattcaaacattacctaatataatcatcatggtactttgatactttgtgatattttttacctctgtgaataccaagaaagaagcaattgtttaaaagcaggaaaatccctgaaattgaggaggcatatgttccaaccccaggtcagctacttaccagctatatgacctctggaaaaacatatacagcaagtcctcacttaacattgttgacatattcttggaaactgaaactttaagtgaaatgacctataatgaaaccagttttatcataggttaattgatataaaaaaggtaagttcttatggcatatttctgatcacaaacatatcaccaaacatcaaaatgaatacccaaaacacttctaacattaaacattgaaataaatgtgagctacacatatatttaagaaagattaaaggccaggcatgatggcctatgcctgtaatcccagcactttgggaggccaaggcaggaggatcacttgaggccaggagttcgaaatcagcctggacaacctaatagtccacttctctgcaaaaataaaaataaaaaacaaattacccaggcatggtggtgtgcacctatagtcccagctactcaggaatccaaggcagaagaattgcttaagcccaggaggtcaagacagcagtgagctatgatcatgccactgcactctagcctgggcaacagagcaagactctgtctcagttaataattaattaatcagtaaggtcattatttacccacttattcataacagttcatggtctcgggtggtcatagcctatcacagcagctcagggaaccagatgggaaccaaccctgaacaggaccctggacagcatgccatcccattggagggtacactcacacacacccgcactcactcagactgggaccatttggacacagcaatgaactgaacatatgcattttggggttgtagggggagacatgagggtcctgataaaacccacatagacatgaggagagcatgcaaattccataaacacagtggccctggcgggaatcaattttttcatcatcaacgttataaggaaataacattgaaagaaacaaagttatttgaggacctgcttatcataaatagaataaaatcaatttcctgaactggaaaatgcagataatagtctctgataagtagcttaggcaggtaaaaatacctaaaataataaagcagaacatacagctgtgtgtctggtatgtttcggaggcccaatgttttccgttgggtttatttaccagtactttagtccacttgaatacttagtttacataatcctgaaaatacaattgagaattttattctctgcttaattaccagggttgatgttgtggatctaatgaaataatgcatatgaaatgacttgaatattgcaaagtaccatacacatgtaactgttgttatgattttccttgcaacttaggtggaagctatttcctatttcaaaactttatgatcggggaaaagtaatcccaaaggacctagaaataagtcgtatgcagtcaaaacatgagaaaatggttgtaattttactcagacactatcaagatgcaacaacctgcatatgtgagcaatgtttcttagaaaggctcagaacactttaccattttctgttgtgttcaccacctagaaaaaaaaaaacggttacagaagagatttctgcaatttaaggaagaatttctaagattgtcaaggtgataaaaccccagcaaggattattgaattaagttcttgagactccttcccaggagaacttcaagatgagaacaggcatctatctgtcctacatggctcagacatttaactgctggagggcaagttaaaggcttcctgccggactagatgagtcgtcaaggtcccttctagctcattcatttcttattcaccaattatattccaactgacaaccttccagttttttaaagggactcaccatatttcttaaattacaactcattgctaaactttaaaatcattgccattgattacactttatataggatacacagaaaatagatgtaatgatctgtagctagatttgacctacagcttgcgggttaatgtgtagggagagtgggaaaggtgactctatctgatgattcactacatgtagaaattccatgatataaaacctgaagtgacagaaaccattgccatcccatgataataattttcttggggtttactttgtggttcaatgtccaggtcagacatgatgacattttagcagggatttttttgtgtttggaatattttctttgttgttttttttttcttactttcataactaatttcccttgaaagggtatgacttggatctgacttgttctgaattttacgctacaataaaacatgttagggagaaacttctgtgtctctgacagcctgtcctctaaaacacatctcaacatgtgaactgatgaaccaaaatgccacaaccttgagaagaaattaactcagagttattcatcttcgaaatccatgttttaggtggtttccatggtgactccctggctagcagcatctttgtctaccagatgtcttattgttcaacagctcatctgtcttcagagtttaaggtttgaaaactgaagtccaagcagaacactttctctaaatatcacagagaagggggaaaaagacaataaaatcattagaatgtttaacggacataagatgggaatggcgagcagagacattgttctgccatggtccaaatcagtgcatgacaaatgatttaggttttcattgggttctgagggcataaatatgttataataatgaaagaaggcttaattatacttaaaacagaactcctactcacttggcaaattttatctccctattggctccacgatatattagttcacatggtaagccacttacttctatcaagtcctgattgttgcaagacaatctgcaagttgatatatgaaagtaacttcaattcagaggctttttttttttcttgaagaaatgagagtaagtggctgctaaaaagattgtacttatatattggcttccacgtctaaagttctgaaaacatcctggaacaaagtcactcactctgttatgttttaattcggtaccaattatgactggccatgcttcaacattgtattccaaaatgagaaaacaagcaacagtaatgataaccaaaaaggttggaagcagtgtagggccaggtgtgaagctgaagaaaaaggctgaaaaccaaagctctgatcctagggttcctgttcagtgaagtgcctggtttgtgtgaaggcaagctggaaagagccatgctaggctgggctcacttgtccacattcctcatggaacagccaaggaaactaagatctagtgagataagtaaattattcaaggtgacaaaaattggttgtgtgactgaaatcagacttaggatcagtgatttcccagttcacgtaggtggaaataggtgatagaggttaagtgattcgtacaatattacccagatctctagaatgtagttttcaaaaccatgcccataaactgtagttctgttttgctttttaatgatcaccagcattgactagtaaacctctctcccaacctactccaccccaaattgtcttttccttgttcttggagccgactttgagactcaacccctttcatgctgagctaaatatcaaatatgtgaaagatgataacatccactaactatgtttaaaagacaagtttcaatttcattgactttctagccaatgctacctgttaagtcaattgcacaagagggatttgccaatcgtctaccatgtatgtgtagggagggcatggtgcagagcaaaaccatgtacaaaacagtcatcgccccctcagaaagttgacactgtagctgatagaaaaatgaactgtcccataacaagatggaatggtatgctgtccccatattacaacctcatgtgaaaagataacacagtttgctaagagtttttcatggacgatcaaactaagaagagataaatttcagctagagtaagaaagataagacggtgggaaacaatgaacgacattagatcctggaagaggaactgcatttggaggaagaaaggagagtgaggaatatttttatctataaacttgagattcttacctcatagggttatgatgagaattaattcggaaaattatataaaccatttagcaccttgcttatcatgttaaaaaatcatgtaaaaataaatgtcatttttattatttaatgatccatacagagttggggtggaaagaatattatagaaagaatctaaagttcttggttcttaatccagtagcaaacagagtaaaataggaatatcatctaatattgcaggatttattttatcattgatgaaatgaaagatttagctaaaatgatctctgggatccattttcactcataaattctatgattctgggacaccaaataaatgttttattcgtctatatttgcccacaatatgcattttttagacccacagggaattttttctgaatcgtggactcagaaccagttaagtgcatgactgacacaacacatgaactttgaacaattacattcaaacatcaggacagtctttgttaacatcgccaactctcttccttattaccagtaagtttttttttttattcgctgtgtaagggcgattaattcacatttcttataaagttgtacaatacaaattgcataagaaaataaatgactcttttctattacttggtggaaaaagttgatttatagtccctgagagaaagaactaaggaagagagttaaaattccacttactatatgagatttttaaagatctagcactcatgcatgttgtgaaaatactaagtatctcaaataatgtgtgagattctccttagaggtaaggttttatattgtcaagacattttttcttttattttttctattgagttactgtctttatgctttacttgtacctcatactataaattaaaagattagtgttcggtgtcattgcattaatgaagattattatttacaacaatagctagaaagtgattggaggtttaagtccagtaacttgagcaattaaaacccttgtagattcctatgaggtttaaaaaatacatgttgttaagggaaacctatgtactcaagaaagatagttattgctagtgtaccttcttcaggaaaccaaaaatgtctctcatcaaaaacggcttctggaaaagactggagttttattaacatcttagtatagatttaaagaaatgaatctcttctcctaacaactagatttcaatcctcttttcagattctctaatcataaaagctaaacatcataaaataattgaagactaagtgataattataatgaacacccaccattttacccacctactctttctctttttctcatgcatttctcttctctctgtaaaagtaaaagcactttattttatttattttattttatttttttaaattttaattttattttattttaattttattttatttattttattttggagacaagagtctcgctgtcgcccaggctggagggcggtggcgccatctcggctcactgcaagctccgccccccgggttcccgccattctcctgcctcagcctcccgagtagctgggactacaggcgccgccaccacgcccggctgattttttgtatttttagtagagacggggtttcaccgtgttagccaggatggtctcgatctcctgacctcgtgatccacccgcctcggcctcccaaagtgctgggattacaggcgtgagccaccgcgcccggcctggcacttacttttctctggggaactgcccctctatgtttcagtgtatcccttttggaaatgtcaactgcagtgacttgcctcttcatcctaacttctggccaatcagtgtgggctattgacctagacatgaatgatgacacttgttttccctgaaagttgggtcttgagcaaagtgacacacaattaaaaatctggatggagagttattttgggttttgagactgccaaagacttcctgcaatgaagatctgcactctgaacttctgagctgctttggttcccatctttcctgtggctgggtccctccctctctctgtttttcctgtgagcacagatgactacattggtgaattcaatcaaacatttaaagaagacataataccagttgtaactgtattcggacaacagagtttatgtgaacatttcccacctcatttgataaggtcattatatcagatattaaaggggagagaaatacatatactttctgctatatataaaaataaatctttttttatatatagtgttgataaacagatataaatatatgtactataatatagatataaaagaaaaaactacataccaatatcactcatgaacatagatacaaatttttttaattataagcacgtagtatctacagacatatatatcataaatatatctatggaatatatggaataatgcactataaccaaacaaaaaatgcaagattgaatattttaaattcagtcaatgtaatcaccccattaacaaaaaaaagagagaaaaaccatattatttgaatagatgctaaaaaaacatttgataaaattcaacacatatttatatttgtgaggctaaggaatgtccttggatgctaatccaccatgttgatttctgattaacctctgttctgggaatgcttttcagctttctactttatgtactattaccgtaaatcctatgcttctgtcaaagcaaccttgaccataagaccacaagtccttccctcaggcagattcacataactttcttgccttttcttggggagttgacttcagttgccctgcacgtttcttgtctatgatatataagccctggatcttggtggtaagcacatggatccatgaactggtctctcggctgccctagactattgcttctgcttgtaaatctgtattcaaggtttctgagaaactgggaatgtcgggctctttctttgtccccaaagcttccttggccttttgggggaaggtttgcatatgcttgctcaccatagaacaatactaagtaaaaatgttcagcaaacaaaaaaatagaacatctttaagatatagtgcatctaccaatatcttaaagccaacatcatacttgattccgagaattcaaatgcttttctaaaaggatcgggaacaacacaaaggcgttttctcaaacaatttctattcaacgctgtactggagatcttgctgaatacaatataaaagaaaataaataaaaggcataaataatggatagatcacagcactgtgtaccttaataaatgtaaaggaattcacaaagacaataacagacctaataagtgaatttgacatgggtacagaacacaaggtcaatgtaatacatacatacacacatgaacaatcaacaaatggttgggaaataaaattgtttaaacaccatttacagtgaaatctaaaaagaaacaaaaattataggaataaatctaatgaaatgtgcagaaggcatttttagtgaaagacatttatactgaaagctacaaaacagtactgatagaagaacaaaacaaatacagaattgacctggccatgagttagaaggtgcaatattaagataccaattctcctcaaattgatttacagaatcaataagacccaataaaaattccaaaagactttttaaaaatagaaatgaacaagttcattgtaacaagcatatgaaaagaacaagaagacctagaatatctaaggcaatcttgaagaagtactgcaaactcaaaggacttactataactgatgttacaactcattttggatctataaaaattagacattatgctgttcatgaaagggtacacaaataaatgaaggcacataatcaacagtactgaaacagacacctatataaggtaacttgaattttgatgtaagaatcaatgcatttctatgtctaaatgaaaagttctttcaacagttgatgccacagcaacttcttttgaggggaaagaacttgaattttactttacatcagacataaaaaattaattttaggttaatcatagtcccaaacatgaaagctaagtctataaagcttttagaaacaaacatggaagaatgcctttataattatagtataggcatatattatttaaatatttctttaaacaatagccagccaagagaatttgacaaactacacttcaaaaaaatgaaatatttgctcatcaaaagttatagttagtaatgcgaaagggtaaatctcaaactaggagaaaatgtttgcaatatgtatcttacaaaggactattatccaggatacgaatgaattacaagaagacaataactcaagttaaaaagttaaaaacacttgtgaatacatacttcacaggagatgatgaaaacccaataaacacttcatattattcgtttcaatgctaatacattttaaaaccaaaatgtgacatcaatttacatccactagaatagttaatagtaaaaagtctaacaattgcaagtgttgaggaagatatgagaaactgcatgtcttgggtaagaaaagtgaaatgtaaaatgatacaatcatgttacaaaactgtttgacagtttctaacatagttaaatacccaacaccttatgattcaacaattctacttctattaatggttaggtacccaagaaaattggaagcatacattcataaaagatttacattgtaggccgggcatggtggctcacgcttgtaatcccagtactttgggaggccaaggtgggtggatcacttgaggctaggggttcaagaccagcctgggcaacatggtagagacaacagctgtctctactaaaaaatgcaaaaatgagccaggtgtggtggtacgcgtctgtagtcccagatgcttgggaagctgaggcaggagaatcacctgaatccaggaggcagagattgcattgagctgagatcgcaccagtggactccagcctgagcaacagactgagacaccatctcaaaaataaattatataacattgtcgatgagagtcttattcataatagctcaacacttgaaatatcccaaatttccatcaatataatagataaattgtatattcattaaatggaatactcaggaataaaaagaatacatttctcaaccacacaacatgaatcactttttaaaatactattttaaacaaaagtagccagacacaaaccggtacatacactaagattccatatatatatataacttcaaaaacaggcaaaattaatctacagtaaaagaattaaagctacaggttacctctgtaggtggttaagattggccaataaggaacatgagaaaacattgtgggacgatgagaatttctatatcttaattttaacgatggtaacaggtgcatatataaatacacacacacatatataactgaagtgtatacttagtatctgtatgttttactatagatcaactaaccacattaaacaaaaaaagacagagagacacaaaagtatctttatttctagatttcattttcatcaatacagtaaaccatagaaagacactttcttgataaatatctttattaaagaagtgtagcaaaacaaagggtaggaagttgaagttaggaggatttaataatcaactggtatttctaggtatggcttttaaagggctgacttttctggatatgacaagctggcaaatgttctcagagtaggctttcaaaaaaataatgttttccattttcgtagaaatcaagatttagtcctttgagtaactaagataatatagtagacttgaaatgattaatttatagaagtcactaccagttgtcattataattatgattttttattattaaaataattattctttgaaaagaataatttgcatatgccacacagaaaaataatgtattttagtaaatggaggacttaaatatttagtcaatgcaacattaggtctactcaccagataatcaagatatagcagtatgattctgacaaaaatatctttctctcaatatctggaatattaataaatagcagtaagatccagtttgatttttttcactctctcaatatcctcgtaactcaagcaaagcaaattgtagataatttgtttttgaaatccagatttattcactgagtgtaaagatggcaatttctgttttttgttaaaatgaaatatattttcccttcaacttgtcatataatttacccactgtcctcactgcttagaatgaaaagagctagtattttacaatttgagaaattgttgtactcagaatatacacacacatacacacatgcaaatatacatatccagattgctttgtgctagcaccaaaatcatcatgaaaataccattttgaaacttgaaaccccaaaatccttttggacttatgttttagttactagtctgtttacacagtcatatgatgacttttctcttttttacaagtctgaaaaagtttctttgcaatctaagggtccaatattaccttatgtatcattatagtatgtatgcctaaatatttttgcattaaataagtagagctctcttaaagttaatatatctttatgaatattataagcagagtagaaatccatacaagtatagtataattggtttcctgtatatgcgttgggcctttttacccagtgactccaggagaaagatctgagaaaatacagaatgtagcaggacttctacgaaagttgagttaccaaagtcaaagtcagatcaaaaggaaataaaggacagaacacttcagggagtagaaaatattccctgttgggtaaaatgtaaagattccatatggtgctggaaatgtgccatgtcctcggcaccccttgtaaatgttttgttagttcactggtgagtctgcctgtttctctctgacttgatttcacagctttggtcactgctgtccacagtcaggcaaacacaaaaggaatcatttagctgttcttcggcactggaaattttcttcatactgaaaaaggcagcagggaataccatttgtctttcgctttattctgagctatggtaactaaggctctgggtcccctggttcccattgatctgtgcaatacagaatagcaaaattggctactgacagccagctggggcaatcagcaccaagacattcagagggctatatttttcttccattttaactaggtccagtagctacctgcgttgcaacagcaccagggtataaggaaggactccttttgaacaccattgcaatcacgatattgagcatagcctctatcccagagaaggcattcaatgcaactttgtgaatgattgaatacaatagcccactatattactttatagccattactctttataattattactctaagcccagagttgggagctgcagagttgagaatattgttaattcctgacttaaaatgaaatgtgtttggtattgtccccattgccctcaaataaggccaagcccccttagattgacacacaagattgcaaccctgatttttttctaacctcacaatcaacatccaaagcccacatgtgatgagtaattcaggggtcatagtctctcttaggtctgagtcttgtgcatcttttcactcacctgcgacagccccacccccttccatgtggaatgcctactcagctttcagatctcagactcaacacctctggctctgggaagacatgaggctttgggaagtccgggctggctttcccttctaagtgctcccacaaagccctgagagccccttattcttcacgcagtgcatggcgattgcatgtctcaaccaccaggccacgtgtttagagacgccagccacacccttccttgtcttcgttactgctgctgacagcatgctctcagtacacaacctttgcgagaaagaataaatgagtgagtggagaagcactagccattttcagggtgaattggtggtaatcagatgctggaatttgctggtggagtcactcagatgaggagaatggccaaaaatttccttgaggtactcaatagaagtttaaaaatgaagaaataaccccaacatcgagtcacaataactaagttgtattttaagtggttgtatttaacatattagcacacacagaatatataagatatttggaaaaaaatatgaaaagtctcactatagatgcatgaagacgttgtgacccaggtccccctggtcctcagctccttaatgctttgttccatgggagtggtttccaggggattcaggaaaacacaccctgtccagacagaaatgagaatacagcctctgggagaaataaggccccagcaaccactcaacatttttctttccatatcccaggcgcaaataggcactgagggaagagtgagcctttcttcctgcccttctcctcttgcaacattttctggagagggcaggaagacctaggtagccagcctgcgtccaggaagggagcctggggcaccttggtgtgatagatgctgaggggacagggccaccagagggagcctgagagtccagagaagactaagagaatcatgtgaccctttgagggacttgaaggtaggctgtggggagtggagggtctacaaagaaggataaaggggcccagctttcctaggtgagccttgaggaccctggagagaagctgatgaggtctgagattactgaaaatactacaggagcattgggatcactgggggagggttctggggagtctggaggatctgggggaccttgggggaaagcgtatggggtttgggagcatggaatgaactaggggagctaggggtggtcattggtggagcttggacgtgcctggaggagcctggagggatgatctgcccctcaatcaatagaaccagttaagaagagaccatctcccaaccctgaataggctcagtgtccgaaggtaggttgtgtagaaatgcatccccacaatcacaagaatcaatgtgaaagtaatatcaggagttttatttcagctattggtgggtcaatcttttttctctgtggaattttttttcttccaaagtttcctgttttcttcataatttaatttccttcttagctttttttcctcctatatatatgatattatgaagtatatatttggtcttcatcctgttttgtgacatacagctgctaaaacctttgaaatctctggaatgaagagtgtcttctgcttgctaatgagatgacttgtgtctggaggccccagtatagcttcaggaagggggctggtctccagaaataaaaaggcatgattagagtattggaccagtcggccccaccctcaaacctcccgggaggagagaggggctgaaggttaagttcatcccaaatgaataatgatttaatcaatcgtgtctacataatgaagcctccattaaaaaaaaaaaaagagggacatatttcggaggaacttcctgatagctgaacctgtggaggttcctggaggacagtgtgcccagagaaggcatgaaagccctgcaccccttccccataccttgcccatgcatttcttccattggggacgttcatttgtatcccttaaaatatcatttataataaacaggtaaacataaataaagtgtttccttcagttttgtgatctgctctagcaaactcatagaactcatagagaaagggtagtagaaactttgatctgtaaccagtccataacccatccattagaagacctgcacagcttgcaatgcctgtctcaagtaggaggcactcttgtgggactgagctcttgaccaacctgtggaatctaaccctacctccaggtagacattgtagaattgaattgagttagaggacactcagctggtgttcattgcaaaatagattgcttgcttggaattttccccacccgtgtaatgtcagaagcattgtgttgtgtttgagagtatatcaggagaaacaggatttgtttttttctatatcctcagagtataaatattgtttattcattggttattttaaacttattcatgtttttttattcttggcctctcttttttcccctaaaagaatatttttcattttttaatttcttctcacctctcattccttcttcatagattcttatttccttgtgtttttctttatatttttctttctgcacaattattttctttatgttcttttcagttttttagcattaacttttcagtttttaataatttcttattttcttctgtttatttttttatttcttcacaatttccttcttctttatgattatttgctaagtttcctttagcttctacctcatcataacttctatctggtcttcttttcatatattattttcttctttataataattcccttcttgggggcttctgtttattatttctttatttatatttcatattttgtttctttctttataatttctctctctcctctatcttcttcatggtttggagtgtgattcttctctctccccttgatggtgatggacacttgctttgggaccaggcagtcctacatccattcccagttacggccctggttagctggatgtccatgaactaaattttgctttctgaaccttatttttgtgacttaaaggtacttatgtagtaactgcaatattgtttttatttatagaacagtttgccaggaaagaaaatatttcaaagacaaattttccactaaaaaataatacagataaaaaacacaaaatatgggcagacttagacttggagaggaggtgcctacacagactaaaaagctgatgcctcttcaatgtgattttctttaaattttatttgtttcactttgtggctgagggtagagtcttgtttctcttgctctttgtttcttttagaaaacatctatctttaagcaagacattagttcccaaaacctgacttttctcagcaaataatacattgatattattcagcttcaaaattttgactgtgacttcaagattgacacatttttaatgttgcccccaacaatatcgccaactaattaagcaaaagtccactctaaacgtaagcatcgaataggtcaaccattacaaggagagcgtttgcttctcttaaaagtttctttccacctctaggtgcattctgtttcaccagctatataaggatcaacagtgtggaaacctgcatcaactggcattgtatttgtaatttattctgatgattgtttagtgtcctttatatttacacaatttgtggaacccagtgtaaaatgaaaatgtgaggctccttgttcagaattattaataatttcaagaaggcaattctagggcattaggcaagtgcaggactctgctgagtctaggtcctgtacagtggcaaaggtcacacgtttgtatcaccggccctgttgatgttgaagttcttagcacgaagctggctgacctggttccaggtacaggaagtgacacccatgaggaactttcagatcccctttatactctcaaaattttagtttttcttttaactttagaaaacttgcctggatttcagttattcatccatagcttgaatatgtcatttttcttactgcccttctctcctctcaacaaccactagtcattccctgtaaaaagtttgggaacattcaacagacttttacagcagaaagtatataatgtggtggcagagaagccctcttctcaaagtcagtatatttcaaccagtggcatacttaggattttgttgtaagtagcttaaaaataacttgcttcatgtctcagccattacttcccacagttgagccctctggccaaatctaaatcatgcaaagggccaattgttaaagtgaatgcctgctaagtaggatggcttggaatccaggttgaggatgaaagcagcaacagcaggaaggaagaacagtggagtaagccaaaagaaaaaattactgctggcacacttctgttcaccatacaattcatccccccgcacatggcaatggagttggtgaacaaacaggtgcataaattaaaatcatgcaattagcggccatgctgcccaccgctgctgccccagagctgcagtaatgctgacactagttaaacaaccaaagcaactgtcattagctaagtgtgttcacttctagaatatcctttttattaacgtgtttaaatagctggatggcagagatttgctgtgagttctataacagaagccagttaacaaccttaaagaccaaattaattggaaagacatattttaaaaccaacacagaacataagctagggtgcataaccagaagctacaattgctcaagttttttagaagaggccatttacattgtaacatcccgccaaaatagtatgattttttaaaatcacagaaattgcacagaaactagatgtttcaaggtatttatgttaacatttcaggataaggaatgagagtcttctctggtgctcatcattttcaggatgaacaattagcattgaatatgcaatgtggtatttcacttcaatctccagaattcctctcaatgcttcattaggctaaagaaattcttttgatactgcgcaataagagtttatattttattccctatttttaagcaaagacaaagagatgtatttaatatgtaagatttgggagaagaaaagtgaaaaatcatcagtgatgtgaactaactttaagatcacacaaacttgaaactactagagtattgaaataacacttgagcagacttaactcttcatccagaatccctgggtattgataacttttatagtgacatttgaaggctttttgtaagacacaatgaattacagggaaaatggagattttatgaaattatgttctacatgaatagtcatagtagttgaaatgtgaagatgaaggaatgaggcttaattagagaagtaccaaagaagatcaagatgattatctcacaacatccctcaggttgttgtctgaaagtaatggtctccatgaactataaagacagggtgtgtcgtgttgagagacaagacccagacccaggttttttccccagctcactaaatgtgtaaaattagataaattctttaacttttttcagcctctgttttgtaacctctcaaatggggataataatacatgtttacctcatagtcttattttaagtgattaaataaaataattcaaatagtgcttagcagtgcctaacactacctttatgtatgtaacttaataggtgatacaaatttatctccctttaccagtagttttccttgactacaaattgaaatcttcggggaagttgtaaaaagcactgatgcttgaagtcacacttggagcttctaattgaacattcttgggtgtggcctgagcatcaggaattttgaaagttccccaggtagttctactctgcggccaaggttgggaaccacgttgctttagacagtaaatacatcattagtaaccacattaatttccattactcaagaaattcactgaacaccctggcatattctaaacatgacaacttgaccatttctccctgaggctcattttctctttgttgcccttctggggttaaaaacaacaacaacaaccaaagtcaatgagacaataattttagcttagaacttaaggatccttttcatgctctacttaataataaatagcagaggacttctttgaacaacatctttaatgtagttgctaaaacaataaaatacacaacagagtacccatcctttaaggaggccaaatatatgatgccctctcttttttttttttttttatcatacatgagtatttctgaaacaagttgagctaaactttgtatcctttgatatcatgggaaataaggaagcagtgcacattctctaaagaaaatgacaatgatttctcattcattctctcattcttctgtttctgttttcatttgctttaaaaacttctttttcttttaagatctgactttccttccaggtgaggaaaaaagaatttccaagtgaggccaattagagttgcccagatgaagcaaagtccccagggatcaatcagaatgcctacacagatgagaaagtaggaatatgtcctttctttctccttgttagagtttagtttctgccctgaggaattctagttatttattttctatcagaaaaaagaatgagctctccacagcacttaactctttcctacttgatagaaatatccaccttcacattgtaaccttgtgctgtacctcattgacttgtccttagttaattatacagaacatctcattcattcagattatgctaactgggaaataaaatatgtttacaagaattaggccaaaacatacaattgcactggaaatggtgtaaaagagatttatcagacgccagctttaactaggagattagatttatgaatacttcccagattgtgtactagggaacattactgttcatcaggatattaacaaggagtttcgtggtcagattaaattgagaaatgataattaaccattttcattataatgatgataaccattttcatcatgctcttctgagccttgcagctctgaatgtagtccgagattggctgcattggcattacatagttacttgttataaatgcacaatctgtattaattctgtagtcccacccccatactacagaattaaaatgttcatttgaacaaaatcctcaagcgattcctatgcacattatagtttaatagacactaccttggatgatctcaattcatattagtatggcagcaaaaaaaagtttttttaagttgaattcataaatttttaaagtctttttcactttgtttatcctatgatataatgaaattatttgaccacagaaatatagctattctgtttttgaaacagttactaatatttcatggcccaaaactttttcacataagataggaaaaagctaagtcaaattatatttcaaaggtcctggtaattctcatattctgatatcctaaaaagatggtaaagaatatacttaccttctcagaaaagaaatattatttaaaaacgctgagcatcctctattggtgatattgtcaattaccaggtagactatagtactatactggtaaagaggctttttcatgtgtagtctgtttccatctaaaatgatgacctctgaagatatggtgtgtgtgtgtgtgtgtgtgtgtgtgtgtgtgtgtgtgtgtgtgtgttggcagtcagtgttcagcttctcttggctgcatccactacagaggatgtcctgaaatggtcagccatgtctccctccagcctcacattactactgtctccctgcccttctgtattgactggaatttggccagagttctaccagagtagtgcctggatcttcatctaacttttaaggaatcaccagacttaaatttatccttgaattaaaattacttaaataactgaaatatcccctccatatcttccaaagtctacccaaatttaggacatggtgggtgttattcctttcctatacccaggcacacaggtcttttcatatcctgctggtattaattattccaatgctcttcttgctttcagaaatccctagatgaaagtagacaccaactctgttcccatgtgttgcacccaaattcagggtccaaacacaagctgcactgagaactcttttctcaaccatttgctccaacaaagtgagaatgggtctattgtttcttgtcctagtgtatatcccccatgaagaaacaagatgtcattgtccctttttgaaagacagagaataaagtgttccttcttgaaagaatgatttcttagatccatatgttatcttataaaaccaatgcaaagtgtgcttttcaaccaaccattttctgagacatcaataaaaataattttatgctttgtatgaataaatccaacaggttttcagtcttattttagtctcttgccttaaaaaggaataaaaaatgtatgtatttcagaaagaaaatgtagaatttaggctgttttcttccattttcttccttgaaaataatctactttggatttcttttgaagacaagtggacatttggcatttacagcttcatagaattgtaaagttatgtctctctagcaacaaagcacagtgccatatttctgaataaatacgttcttccttgagttaaaattgcttacaaagaatctgtaataaatcaatcttagtctttagatttactgtttaaggtcaaactatgtcaattgtgtttttaaattcagatttcattttgaagcaacattttataattatgtctaatttctatttgtgcttatctgttttgaaaaaatttagattaggtcaatcacaagtcaaaaaaatgactaccttctggctccctctcaaaaatgtccactgttcaaataaaaaaaaataacattttgctcagaaattctaattttttaaggggtgaaagtaagatgtgtttatttatggtatattcattccagagtattcttaagaatgcccttactggaaagatgttaggtctgagaaataaagaggagcttgaaaactcacaagaaagcattttttaagccagcagtgaaagaacttttgatgtttcaaggtcatttcactgtgggaggaaattgatagcgtctaattagagtagaaatgctataaagtctgttcagtagagatgtacttggctagcaggatgaagtcagaggaagtatataaaattttctcttattgacttacattttccatggtccccaaaacttaaatgtatgttaatatcacctacagtgtttttatccttgttgagattaaaatatgaaacctgggagttttctcctgcttagttccttattatgggtattcaaacaaatgctgagttgtagatttaattccttatgaattgcctccacttaacaaaatcccaaaacatttactcagaggttgctatgcaaaagccaccgcagatgcaaaagatcctagagatgcctacaatttggaccttggatttaggtgattataattatagttgcaaataattatgtgtcaatattccgtattttacctggaaaaaaaaattctgttcaaaagttttaaatgtatttacactcactttccaaggtagggggtgatagtattcatgttagtcatatatttatatttcacactatttctctcttctgctttcatcgattgatgagaatggggaaaaattattataaacttaatgcctctgcagtttttctgtgtcactaaataatgagagtctgagaaaatatgtattgtttagcaggacatcttcatgtgttttccaacttaaaaaatacaacatgcatgttttcaattgtaagtgggagctaaatgatgagaacacacagacacatagaggggaattggggcctatcagatggtgtagggtgggaggaaggagaggatcaggaaaaataactaatgagtactgactaggtttaattcttaggtgatgaaatattctgtacaacaagcccccatgacacaagtttacctatgtaacaaacctgcacatgtacctctgaaataagttaaataacaaataaataaataataaaataattgtgattaaaaagagacaatatgctgtaaaatatttatttaataaaatagctttttaatctgtacagaattgaataaaaaataaataaaaatataacatacttaataacctatttccaaatctattcttattaaactattaataagctagggatttttctgaaaaacaatacttttttcttagaagaatataatgttggattccttgctttaactttgtgatgcttcatggatcacctatctcaaatctctcattctacttaatgacccaggtttcttgaattgagtgactagagaaaggaatttatagaagatctttaagatgcttcatttttacccctaaaagaaaaacagtgaaaccaagaggacggcgctagctgtagataatttagggtaattcaacccagagatggagcaagtaattatttctgttcttgtctcatcctggttgccttctatttatcctaacaaaaaagccacaacaagttccctataaagagttcctgttgtccattttataaagaggaggaggatcaactttatttatgaacattacaatttatcagagggactctggttctatgtaggcaaattccaaataacattaaattcaaattctttttattcaagttctatcagatttgctgcccatctgttaatcccacttgacttcacagtgctgtttatctcctaataatgtttttataggattgccattgcatactattttttttgtgtgtgataggtacacatagaagtcacattcattgtccttcctagtaatatctgcatagattctgattccatgatcctttaaaatgagcaaagtgagaggtaccattccagaaagaagaaacaagtcaccttgtaaaatgatctgcatttttgtcatgtcaggagcctgcacgtgttgggttacttcatgaagcaattgttgcctacagtagcatttcagttcaaaagcctgttccgttaaatgccatttcccagttcaaatggacttgaactgattcagcatacaaatggtaacatactctttaaaaatatagtgcagtggttaaacgtgaagattctggagacaggtcatctgggttcagaacctgtacttgctgtgtgatcttaggcaagctacttgatcactgtttcctatatttaaaatagggggacaataacaccaagctcataaatcactgtgagaattatgcaagtttattatacatgcttctcatgtgcctgatacacactgagcagtcaataaacgcttgctgcttctatttgaaatcttaaagagaccatataacaaaacctcacctttgggcaaatgagcaaactgaggctcaaatgttaaataattgacctatgtgttctgtccattagagtccacctttactttctccttatttaaagaaagttgaatgcaaaggcattacttggaaaacctgagttcaagttccagttccaccctacatttgttccataaccttgagcaagttccttaatatttctatatggctcagaatggttaagtaatttttccaaggtcacacagctagtgagtagtgggacttggattcaacttgagcaagtctaattctaaaatcagatttttgtccctactataatgtcaaaggttgctttaggtaatatgtacatatcacttttggtcaacgaagaaactgaagttaaatgtctaatgcacagttacagcaaatttagacagagcttggactacaacggaagtcactaagctatcaattaaatattcttcccactagatcagtgattcttaatcctagctgcatattagtcttacctgggtaacccacttcaaaaagacacctttacctggggccctatctcagacaaattattttttcaaagtctcactgaattaattgtaaggtgctaatgtgaagaactgctgaccttgactgaaagagtgcaaagaggattattttgccaaaacagactcactaccaggttgcttccaaattaactaaactcagaactgtcctaacacaaacacaggtgggagtggctctaagccctgttatttacccttcactttctaacattttatcaaagtcagtctccagtatagatgagtagctatgggaaaatactaggaataatcctcccaggccctcttatttttttcctggtttcttatttcttaactggattgtctcctcctctatgctattatattccactgctggattagtcttactgacagctcttaccttgctattctgctttccaagagtttcagtgattcctcagcacccgcagaggaggtgtaaatacactttatctggagctaccaagacctctagcatctttccaaagtgacgtttccaaacttttccatgactaattcaccttcattttacatgccttaaagagcattgtaactccatagggctttctgaaactgcactgtgctgtcaccctttgtgcttttgctatgttattcctttgtctctaatgttttgccctgtaaccctacttgtgagtatcctacttattgcatcattaagcccaagcaattttctgctttcccatcttgactatgactgtttatccttgaatgcacaaatcctatccagaccattgaaatgccattccccgctttgagctcaatggttcaagactagcctgtccaaaatgacaaaaccccgtctctaccaaaaaaaaaaaaaaaaaaaagcaaaaatagtcaggcattggtggctcactcctgtagtcccagctactcagaagctgaggctggagactcacttgagcccaggaggcctgtgttgcagtgagccaagatcataccactgcactccagcctgggtgacaaagtgagaccctgaaaaaaaaaaaagagagagaaagaagaaagaaagaaagaaaaagaaaaagaaagaaaggtaattttcttgactatttcatccatccctttctcttctcaactcctcaccaaaactttttttaatttattgaacttccatagaaatttttttaatttttaatttacttcattactttgtcacttatatttaaaggcagagattattttggatttatccttatattccacacatcccaaagcctagtaaataatactatagacacttctagtttgccttctcctatgaaagaacaacaacaaaatactagatataatcctctcaggccctcattatttctttcttggtttcttatttcttatctggattgtctccccttctgtcttattatatcccatttctagatgagtcttactaacagctctcacgtaattctgctcttctagagcttcagtgattcctctatgcctacagattaaaggtcagtgccctttatccagaactccctagacttgtataatctagtcttaagtgaccgtcccaaacttatctctatcttgtttacctctaccttctaacattttatcaaatatttaatcaaaattttatctcttctagtctcaagccacacccaaccttcagatggaacatgtggatctggcctaagcccacctgtgcacaccattctctggtccatggtgactgcttccaggcacatgacctaagctggtcatagaataaattttaggagtctgctttagggtttgaaccattaaatgtgtagatagcaaggttctggtaattattctgcaactaagagaaaaaaaaaaaaaactgtttcaaataagactaagagatagagaaagaaaggttgaatcccagagacacatctaggacctctctgtccaggatagcctaaaactagacctctctctgaaccatccagttatataaatcccacacatttacttttatgtttacattaggacttctgtaccttgaaatctatgaaatcacaaacacaagacattcactcaataactgttaggtaaccaatcagcctttcaaccgcattaaaatatgccaggaggaggctatataggataccgcaacaactctctggtttaatttgactaagtttttatttttcaatttttgttttttatctcagcgtaagagatgtaatatactaaagcttatctgatatgaggctacaaaataaacacaaggatagaaaaaaccctcatgtccctctctctattaacctcatgcagcaagggtctgtgttcatcattagtttgactttgcaatgcagaaaatagacagtctcctccaatccacttaattgtaaatcaggatcttcagctaaggctcagaacaaagatcaaagataaaaaaggaaaaagagaaaccttcatgtccggatcatgctcttatcttcaggacaacttgagtttctttcaggtatttgtaaaagcaagagaaaatcaatgagaattaaggtcggaggagacgaccaataggactgttacaggtttatcatgttttggatgcaaagtggctggtgctcatcctgagtccatcatctgtctcaggaagacagcaaactattgtgcttgtgttttcagaattgcagtggagataatgctgttaacacaatggggcattgcaagaaactcataggcacaaggattgatcacagatattgcttatgggatctcagagggtaaagaatacccttggatgaagagctgcttaaaagatcatggacagttacagcaaatttagacaaagcttggactacaatggaaatccaagaaggttgaagagttctatagaaccatccaggaggcactaaactcgagatatatttattacacagcagaaaaagttgaaaaaggaaaggaggaaggtggtaaaagtgaagtagatgaagaaatctgggtagcctaaaatagtatatttatatactaaaataatacattaaggctgttctttccttgtgttgctggtggagatacagacttggaatacataaaggagcaagttactattattatgtggaacgattaaggtggagaacttcaaatgccacatcaattattatgtaaatcctaatgatgccaagaaactcacattcaactaaagggtcctatgtgtgtggctgaggtaaaatgtggccttttgaagttgtcaataaaggaacaaatagattgttgtgactatatagggtctgatgagccacttaccagcagcttccaagaggaaaatgtacaggcccaaaaaaatgtcacagaactgccaaaaggataggaaatcgatgacataaatgatgaaataactcattcttctacttgctctttattggtgttaaataattgctaaatttttatttgaatggaaaaacagaaggaaattggtgagtgacagctccttcaaagatgatcctctaaaccagtggtccccaacctttttggcaccagggaccagtctcatggaagacagtttttccatggatgaggggtggggaggatggtttggggatgattcaagcacattacatttattgtgcactttatttctagtattattacattgtcatatataattaaataattatacaactcatcataatgtacaatcagtgggagccctgagcttgttttcctgccactagagggtcccatctgggatgacaggagacagtgacaggtcattagattctcataaggagcatgcaacctagatccctcaccatgtgcagttcacaataggacacacactcctgtgagaatctattgtcactgctgatccgacatgaggcagatcttgggccataatgtgaacaacgggaagcagcatctgtattgaacagatgaagcttcacttgctcgcccactgctcacctcctggtgtgtggcctggttcctaacaggccacagactgccaccggtccatggccctggggttgggaagctttgctttaattatgtccaaaaaagtgtatgtcccttaaacaatttagatcatcaccaatgggaaaacagtggatacttctcatggtaaacagaggaaacagaaaaggaagtaagctaagcaagtcatgagtgaaatttactaggcttttgacctgggagagtagttatctgaggaaacttagtgtagaattgactatagtttaccctggcatttggatagctattgttggtgaaatattcacactcgttcatgcaactactttatgacatatgaactctttgcctgctttattttccttagcatttaactttaaaacaaaattttaaaaaaacctaacattgtgtgtgtgtctagatagataagagagagacatagagacatcaacacatagatacaaatatacagatatagatgatatagatacagacacatcaaaatatcagcctatctcagaaaataggaaggggaagaggttacttataatttgaccagaatttagaaggctaagtagtatgtgcccttggagttaatagtagcagtacccaggttgagaaccacaaggaaaagacagccccataaaaaaacaaggactcactactctgctctctcccacttttcaaagtgattgccatttgccctttattgacactcctttgttattttccccagagaaaaataactatgcattattctagcaggtgtactagtaaccctcacttctctccattcccacacacctgaaagttccccttccagggatggggaatcccagagacatatctagggcctctctgtccaggtcctagacagggatctgggtctggattaacatagaaagcccttcacattttacaatgtggatgtgcatggttctgagaggtgaagccagctgagcttctgggtcagatggggagcctcagaacttttgtgtctagctaaaggactgtaaatatacctatcagcgctctgtgtctagctaaaggattgtaaatgcaccaatcagcattctgtaaaatctgtgaaggtctgcggctcactcctgaagtcagcgagaccacaaacccactgggaggaacagacaactccggacgcaccacctttaagacctgtaacactcactgccaaggtctgtggcttcactcctgaagtcagcgagaccatgaacccaccggaaggaagaaactctggacacatctgaacatctgaaggaacaaactctggacacaccatctttaagaactgtaacactcaccacgagggtccacggcttcattcttgaagtcagtgagaccaagaacttactggaaggaactaattccagacacagttctgccatgacactcttcagcctggtagcccaggcaattttgccattgacttttctaggttgtaagacttagctcttccttgaaatagaatgaatcttcaaattgtaccacatgttaatatacttaaaaattaacaagacagagaggtggttagtggctataaggtgttcactgtaaaattcaactttgctgaatttcgaaacttatctattaataataaaaactgggaagtattagcaagtgagtattttggtttttgtggggttttgttcttttgctttgtttcgttttgtttttaccaattctgtgtcattctttatttgaaatgcaacaagaaaaacagcaagctgtcagtcatgccattaacaaatggatgttataaaacccatgcctgtctgggtgcgtttgctcatgcctataatcccagcactttggaaggctgaggtgggtggatcaccagaattcaggagtttgagaccagtctggccgacatgctgaaaccccatctttactaaaaatacaaaaaaattagccaggtgtggtggcaggcgcctgtagtcccagctcctctggaggctgaggcaggaggatggattgaacccaggtggtggaggttgcagtaagcagagatcgcgccactgcacaccagcctgggcaacagagctagattctgtctcaaaacaaaacaaatcagaacaaaaaacaaaaacaaaaataaaaatattattaaacaaattaaaatatttaataattattgtacaaagttacatttatgatttattcctaggattataattattattacattccaaatactgagtcctttctatgtgtcagttaccctgtatgcattatctaattttattctacagccattctatgaagtaggtattataattatgaactgatttacaagtgagttagccaagactctgggccattaaatatcctgcccattgtcctcagacagaggagccatgtgtcaagctcatgtcttgagcacaattccttagatacagcgttataataaactcctttcaagagatgcaatgagtggacattttctctacataacatgtgaataagacacattgaggaatgccattaggacttgcccaagtaaggacagagaggatacactagcaacattttaatccctgattgtatttgaaatctgccaagtacaaaataaacatcaaaggcagctgtggcagccagatgtcttctttgtttcttctcatgtgagccttctccctgctcaagaagcatgaagctaagtgtgatctaaaaggctatctctgctgcccattcattctttggcctttgtacaaacactgccagcagtacatcacttagaacagcacagcacagcaatgatttctataacagaaacattaatcaattaaaaccggaagtaagccagcaaacacattttactgagctcaccagcaagtcatcatcgcatagatcatcagatagaaatgtttcttgactaaaaaacaaaaagaaaactaaactgtgagttggtgaccaggtaccaggccttgttttgtctacttgtgtactagaatattctctccctttctatttcactagtcacatgatgaccacaagtcatagagtaatattttttaacttactgcataaatggtggggtttatcactttagtttctgtcaccttaaaaaaaatatggtttcttcaaagaatttagataatcaccaatgggaaaaaaatgaatacttctcatggtaaatggaggaaacaaagaaggaagtaagccaagcaaggtgtcagtgaaatttataggcttttgacctgggagagtagttatcttaggaaatttactgtgaaattgactatagtttaacctggtattttgatagctcaaagaaaccatattggattatttaaactggaatgatttgctctatccctattttctcaaaggaagtcaaataaaaagcatccatatggttctcatttgcactgctataaaaactcatatttaggtggcatgacactgcaatatacctggtataaaaagcagcatttttgagcactttctatttgtcaggcacttttcagaacagttttttttatattaactaacttaacacataggtcacagtgtggttaagtaacttgaccaaagtcagtaagaggtggacctaccttctcagccattacgttctacttcttaaatatcacaatatgttaaatgtttattcagcaatttaataattttaaaaaattattaccaatttcaaaagcatgagtataatccatttgatattaagataatatcaataaggacgtttaaaaatatacttgtgtaagtctagcctttatattagaaagaccacccccccccgcccatgaccctaggagtctttttagaagtaaagtaagggaggagagatttaattttagtcactctcctttttagtgtgacagagaaacctgaacgttgttacaatggagaattgccctgttgccaattgcgaatgtctccattactgagtacttaggagaagactatggacttgttgatgagataaacatgctcaaaatttgacatgggcatccagttctgatcaacaataatactttctcttattgctcccagaatgccttactccaaatagaaataggaacaatatcagtaaacactcgttgctgtcctaagcatcactttctgccttgatggcagtggggccagccaaagagtcactgtcagctgattgtgggtgagtgtttagacaggattctttaagtgatgaccgtcacaaacacaacccaaaatatctatcaaaaaaaaaggaaatttattgaatcacatagctgaaaattccagaagcctcttgttttagacaatgctagatccagataccaataaaaatcagttatcattagaaatctccctcagctctacttccctctgtgttttattttcagaacattctccatgatatcagagaatggtatcacacccacataaaataatattttgaccaaaagaagacagagatgcccggcagtaggaaatagcagactacagtgtgccatgatttcttgaacgataacaggcttattttcgatggggtggctatcagtgttggagcctttactcttcctggaaaaaactgcagttgcaaatgcctttttctcatccttctgctctcaccttattcttctctcatatcattggcaccagtatatatacctggtcatcaaacccagaattccaatatcatccttctttctcactaagacctttatttctttttcattattattatactttaagttctagggtacatgtacacaacgtgcaggtttgttatgtatgtaggcatgtgccatgttggtgtgctgcacccattaactcgtcatttacattaggtataaatcctaatgctatccctcccccctccccctaccccacaagaggccccagtgtatgatgtttcccccaagagtccaagtgttctcattgttcaattcccacctatgagtgagaacatgcagggtttggttttctgtccttgcaatggtttgctgagaattatggtttccagcttcatccatgtccctacaaaggacatgaactcattcttttttatggctgcatagtattccacggtgtttatgtgccacattttcttaatccagtctatcattgatggacatttgggttggttccaagtctttgctattgtgaatagtgccacaataaacatatgtgtgcatgtgtctttatagcagcatgatttataatcctttgggtatatacccagtaaagggatggctgggtcaaatgatatttctagttctagatccttgaggagtcgccacactgtcttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttgttttgaaaagtgtctgttcatatccttcgcccactttttgatggggtcgtttgattttttcttgtaaatttgtttaaggtgtttgtagattctggatattagcccttggtcagagggtagattacaaatatcttctcccattctgtaggttgcctgttcactctgatggtggtttctttttctgtgcagaagctctttagcttaattagatcccatttgtcagttttggcttttgttgtcattgcttttggtgttttagacatgaagtccttgcccatgcctatgtcctgaatggtattgcctaggttttcttctagggtttttatggttttaggtctaacatgtaagtctttaatctatcttgaattaatttttgtataaggtgtaaggaagggatccagtttcagctttctacatatggctagccagttttctcagcaccatttattaactaggaaatcctttccccatttcttgtttttgtcaggtttgtcaaagatcagatggttgtagatgtgtggtattatttctgagggctctgttctgttccattgatctatatctctgttttggtaccagtaccatgctgttttggttactattgccttgtagtatagttggaagtcaggtagcgtgatgcctccagctttgtccttttggcttagaattgacttggcaatgcaggctcttttttggttccatatgaactttaaagtagttttttccaattctgtgaagaaagtcactggtagcttgatggtgatggcattgtatctatacattaccttgggcagtatggccattttcacgatattgattcttcctatccatgagcatggaatgttcttccatttgtttgtggcctcttttatttcattgagcagtggtatgtagttctccttgaagagttccttcacatcctttgtaagttggattccgaggtattttattctctttgaagcaattgtgaatgggagttcactcatgatttggctctctgtttatctgttattgatgtataggaatgcttgtgatttttgcacattgattttgtatcctgagactttgctgaagttgcttatcagcctaaggagattttgggctgagacgatgggtttttctgaatatataatcacgtcatctgcaaacagggacattttgactttctcttttcctaactgaataccctttatttgtttctcttgcctgattgccctggcaagaacttctaacactatgttgaataggagtggtgagagagggcatccctgtcttgtgccagttttcaaagggaatgcttccagtttttgcgcattcagtatgatattggctgtgggtttgtcatgaatagctcttatttttttgagatacgtcccatcaatacctaatttatcgagagtttttagcatgaagggctgttgaattttgttgaaggccttttctgcatctattgagataatcatgtgtttttgtctttggttctgtttatatgatggattactttacttcttaaatagttttttcaaatcaatccaacttatccctattactgtttctctcccttggataataacagtggtattataattagtctttctgactcctatcttgtcccttcaaatccattctccgtgttgttgccactataatcagtctgaaacacaaattctgccatgccacttccctgctttaaaattatcaagggcttacaattgttgtcagaataatatccaagcgattttacctgctgcgtgtgaatagtatacacttctagaattttgctgcatcaaatgttgccattagctatatgtagcaatgtagttttaacttcaattgaaattaattaaataaaatttaaacttcatgtcttcagcttcactagtcacatttcaaatgcccaatagccacaggtggccagaggctatgtatcacacagtgcaaacatagatcatttccatcttcatagaaagtcttaatagtgctgaggttccatggcctcatatctgtccactacccaactattttcttaaaatagtgctgaacaactggtagtttttgagtgagtcatacatattcatgtctctgtagctttgctccttctagtactgtttggattgctcttcatgtattgctagataatagccactgaacattctttaagagtcagcaaaagtgtcaccttctctagaagccaactctgaaaagtgggcttcagccaagcgttttcaaggtattctgtgcatttgctcacctaaccatatcacagaaatattatctggtttgtgcctgacttcctaagtgacaacaatggaacaaacaaacaaaaatgtcttgttctgtgttgttttatcagcaccaggcaaaatctgtggcatgtagcaagtgctctgatatatgttttctgaaatgtaataaatcatgtaaagaggcaaattaagcattttaacctcattaaacaaacaaaatacctactttaatttttgcaattaatgtaagcagtagctatccttgattttgtacttgtctctagtcctggcctaacctcaattcaactccaacatcatatgtcagcctcagaccatattcaccctagagctgttttcctaatttctttacttacttaacacagggcaaacctaaggaatgagttgaagtaagaggatctaggttgaacaccttttccaagaataacaatacagaaggaaagtttacattgttgtaggttgcctcagtgtcatacattcctcagaatatttttacccacgagagatcatatttcttctttatatgaagcactgatggatacagtatccatgaaaataagagggcccacttttctagagatataacatggttcacttaaaacatgtttagggacgggaagcccagcattttcacttgaaactgttctcttctttttatgtttagatttcccacataccttagcgtagatggaggttcccccacaaaaagtatatatggctacttctccttcttcttcctttccaggagaaactgggagagaagtggcattccaaagggactctgcaagactgtcccatgagctttggtaggttttgcataatttagaacctaatatcccagcaattcagttaaacattttgcatgtcagtctaaatagcatctaaatcttttgttctttgacatttaacatcattctgttcattccagtaaaggttgttgcctttttttttcaatgactttctgacctgtctttaaagtcagcattccaatcagtctccactgacgtacagagaatagtgacatattgacttttacaagaaatgaatcaaaaggtgacagaatatgaatcgatggaaccttagcactaaattttccatataaatgcaagtgtcaactaaacaaagggcttgcctctttgcatagtcaatgctaggtggtttatccacataatacacacttgagtcaaaactctgcataaccttggcctggtgctccagtggaattgtgggtcataatttttttaaatataaagttgacttttacttgaacacttgatcgtttaaattagtcctacccagttctaattttagctatgaaatgatgaatggaatgaaacctcagaaatttccaatacattgcaaaatacagattacttaagttacttcatctttaaacttccttggagcttgctttcgtctgcatttacatgggtattctgatgttcccattatactgctagtactccagcccattagacactcattcttccattgtcaaattctatttcgtgtttcattctgcagagtcccttgactgtttccggttttctctaggtcttctttccataatccaagagacccacaccaattaataagtcattaatattaattataataatgctaatgttagcaagagtttattgtacgtttagtttatgtcagtcactatgcttagaagtgtatccaaattatctcaggcaatcctcaaaacaattccatacagatagtattttactgctatttatccacattttagagataacaaaattgagacaaagagaggctatttaagtatcacatccatggtcacacatctagtaaatgtcaacgctttctcattcaagcccaggactgccaaatttcaaaatccaagctcctaaacagatactcctattccccattctgatgtattcaagtttaatttttgaactataaaaaaatctatttccatgtcacagtgtttaagaatatatcaacaatgtacattatgtcaatcttatcatttgaaaattattttaaaataagacacaaatattagctaatgcacatttacttttccctttctgaccttaatatatttagttataaattctaatctctataaaaccattaccataactaagaaatatcagccaaacattatatgaaaatagtttttttttaagactgtcagttgataacggaaaagaaaggagcaagagtgttattgagaagttatattactgcacaaagtagaggattgctttgtgatagattctctttgaatctgagaagtcattatttctaacagtacatttcagataacacatgcaattaaaatgtcttctttaattatcactaaagaaaattatttcaaaggacagcagcctatagaggtactttgccatgacagacaaacttaacaaaaaggatgaagaaagaagaacgcaatggataaggaatgtaaacaaatttatgaaagaaataaaataaagggtggcaagtgaattagcaaggtggaataagtaacaactaaaagcctacaggatattgacgtaggagtgggaactaaaaacgaaggaaaacagaattagttttgagtgttacatggcggatgaaccacataatcctcacccactctgagcaacacggaaatgatggtctatcttatctccatctggcaggagagaggagggatagtttctagagatacaaaaaaaaaaaaaaagatttttgacctcaggcccgcaagtacagtgaacgtctggggtaaagtatgagtttaaaaaagggcggagatacagaagagtctcaatgccaaatggtagaaccctgctcataggactctagaaaaggttgacaaaaccatgcccccaagccctcctttttttctttctttcttttctttttttttttttgagacagggtctcactctgttgcatagactggagtgtagtggcacaattttgggtgacggcaacctccgcctcccaggctcaagcaattctcctgcctcagcctcctgagtagctgggattacaggtgcacaccaccacaccccgctaatttttgcatttttagtagagacggggttctaccatgttggtcaggctggtctcgaactcctgacctcaaaagatccacccgcctcggcctcccaaaatgctgggattacaggcgtgagccaccgcgcccagccgccgtcctcttaccataagcattaaggcaacagaaaactagaaaaatgttctctggaagaactgaataattacagggaaacaatctttgcatactctcattgagagtccagctgattgtgcaatgactcagcagtgaagtccacagaaccacaaataccccctttgcccatcagtcttcaaccttttaaccaggtttttattctttcattcttacatatgtacagacacgtagacagctgatgaaagccttcaatgtcggggaaaaacaactaccagaaaatggagggcaaaaaagatacaaaataaggtaaggctaacattttcaaaaacctcaaatttatgtcctcaaacaagtaagaaaatgtattgggttaagaggacagtaagagagaaagagaaagaaagaataagtcaaagaaaaaagatagctcttataacttaaaattggataatcaaaataaaatttgggcagcaaagtggaataatagtataacagttgaggaatatcccagagtagaataaaaagataaataaatgaaagatactggaacagtatgagaaaatcaaaaggtaattacaaaagatttgatatttagataacagaaattttagtaaaggaaataaaagcaaaagaattatatatttttctaaaaagtggaaatgttccagattgaaggactgatgggattagctgaagataaacctgcattatgaaatttcagaattctagagattaagaaaacttctaaatattttctgcatggactgaattgtgtcccccaaaattcatatgttgaaaccttaacccccaatgtgacaatctttggaataaggaagtaattaaagtaaaacgaggtcataagggtggggcctcaatcggataatattggtgtctttataagaatagacatcagaaagcttgctctttctcttctccatgtgaagaaacagcaagaaggtgatggtctgcaagacagacagccctcactagaaaccaaatcagctggaaccttagtcttggacttcccagcctccagaactgtaagaaatcaagagctattgtttaggtcactcagtctttagtattttgtaattttagtcccagcacactaatacactttcatagaggaaaaataatcacatgcaaaggatagggatcaaaataacatcagactttccaacagtaactttggatgccagaatacaatacagcaacatctttaaacattgagagataagtgactctgaacctataatcataaccagatatggggttatcgactagaatccagactggggttttccagagtaagtggacatgcagcaagcaattaatctccatcagtttaagtttagggtattttgccatagcaaagctaatgtattgaaaatttatgtcagataattgtatgttctagtcactttaatatttctagtcactgtaatatttccatttctgacataaggtgtaccacccagtaccatctctccctatttctaacaaatatgtagcactctcacataaagtatcttaaaaggcaactttaaatcaaatcatgtactttcattctacactttattggagatctaatatctggacatgcccaacaatccctcaaagttcctcagattttcagttaatgcttaattttttattgtatccaaggtattcccttttggatagggatacagtgatcccaatccgcctttgaatagtttatttgtttatgtatttattcatttatttttgagacagagtcttgttctccacccaggctggagtgcagaggtgcaatctcagcgtcctggctcaagtgaccctcccaccgcagcctcctacgtatctggcactagaggtgcataccaccatgcctagctaaattttgtattttttattgagatgagggtctcaccatgtcacctagactggtctcgaactcctgagctcaagcaatccccctgcctaggcctcccaaagtgctgggagtacagacatgagccatcatgcccagcacctccctctcacatatttgatacttgattaagaaacttgaactcactgtgcagcttagcagcttataatttagctattgcttagttaactgtagtcttgtttgaatgatatactatttcgtcagtactctcaactattttaagtttgctcaaggaagagacaataggttttaatttcttttcagacattaacacaattttaaacacaataggtaggcacaaaataggcacttactaaaggtttgctcaataaattatgtcttccgcagggtgctgtggctcacgcttgtaatcctaacactttgggaggccaaggcaggtagatcacttgaggtctggagttggagaccagcatggccaacatagggaaaccctgtctctactaaaaatacaaaaatcagccgggtgtagtggaaggcacctgtaatcccagctacttgggaggctttggcacgggaatcgcttgaacctgggaggcggaggttgcagtgagccaatatcgtgccactgcactccagcctgggcagtagagagagactcggtctcaaaaaaaaaaaaaaatagattatgtcatgttctccactaaggacatgggagatcatgttcatttacccagaaaataccatcaatgacttctgtgttatagattattaaatattgtcaatattttgaggaggcttcaccctttgtccatgcatgaatctgaatcatctgacttcactgtcatctggtgtgacctaggaatggaaactagttttaacaccagctcaggcagaatataaatatgaaagtaatttcctgaaagaaaactattgcatcctaaggctaaatgttaatgacttcatattttccaggtttatgcattatctcagccacatttccctgttaatttatatattatataatggtagagtgagagtaaacactggagagcacttagtccagcaaagtattttttgcatgagatggagtgacgtgcccagagtcacatgacttgataatgataacagaagcagtggggccagtgtaatcagattccagtgcatgtacctcccagtgacctaagagttggatgatgtcatttctcttgttgaggtttttttttttttttttgtatgtagagatcgagcgccatgtctatcacaaagcatatgagctgatgtttcctggacttaacgtatataacactaaatttcaggaaaataatttagcaaggtagctaaatgcttctgtatataggaaatgctgggtactgcacagcgtaatcaagacattttgtttctaaatctaattctgcaaaatttcccttccatttccccttctaattttctattagaataaagcaataaggtaaaatatattaatcaaagtcatcagttcaggagaacaggaacccctagaattattcaaaccatcgacttggatgaggtagttcacattattaaattaatttgaagagtcattaattaacttccttgcatttttaaatttcatagtaacatgttcaaggatgatagagcattgaacttcattagctgattgtttgactcagtatttatagaagactgctacttattcagaaattcagttatttgtaacactgtttttcttactgttacattttaatgaatctcatgtcttattgtcagactcactcacattcgataaagggtagtggtaggagctatcttttatttctattaatctctttcccgaggttcattagcagggaattctttcctgttagatcaatggcaaaatcaccgtctgaagtcattttgccttgagcaataatctgaacatctttcttggaaatgatccgcgtgcccactggaaactttgagaagtagtttttaattgcatttttgttagattctggtgctgccaagccctgttttgatgcctgagacagtatagaaacaatttgaaatccacaacatgggaagattgtggtgccagtcaagctgactgcacattagcaccaatgttctttacatacaggtttaataatcagaagaagaatcctaagtgtttaataattgaacatgtgtttaatatttaagcagccagatctttccagttgttaaactaatattgaagtagggtgaaagcattctacttactggcaactctccatcttacaaatatcttttgaagttcagtacagtatagggtctatcactataccgtctggcggacagtgttacttatcataaccaggaccaaagacaatgcagaagctttcttcttgtcattacagccatgtgtaaaacttatatgtgcaaaaactatagtcataattaatgattttttttaatctcacattttatgtttttttctttctttgtggctattgaatgcaggaatagctatcctgaaaatgaaaaagaaaataaggcaatgtttacatcaggttatgtgctgggaattatttcacttctaactaatcttcaaattgcaaaggagataattatttacttaaatacttgttagcccagagttttcctgtactgtccacagtgacttaacaattttccttaaggattgttacatattgacaacacttgtagccttagacttcacagcagtggctccaccccaccttccaattgaccttgtacattcttgttgcaaaagatatgttcagtttactgatcacaaggtattttgtattggagcagttaatttcacctacgtgaatatgagccagagggttttaaaaatcttatatttcttccaacaatacctgttcttgatatttctgctcgaaattctgattttaaaatgataatcgtgactttgaaattcactttatttgattgcagccttatcttttccaccaaggattttaggtgactgccatgcaacttagttccagatggccttgaattttcctagtatagcttcttttaaaatttgcatgaggaaattaaaatgactgttttgttcttgatggatacttcaaggcaatcttttagcaaaatctcatacttttgcacaaacttttaaaaacttttaagttcagaggtgtaagtgctggtttgttacataggtaaacttgtgtcgggggggtatgttgtacaaggcttaatatttgggtgataaatttaaactttaaaaacaattaaaggtatcccttatagactagcagttaagtgtggctgctcattagaaatacttagtgaactttgggaggccaaggtggatggatcacctgaggtcaggagttcaagaccagcctaggcaacatggtgaaaccccatctctactaaattcaaaaagtagctgggcacagtggcgcatgcctgtaatcccagctactccggaggctgagggaggagaatcacttgagcccaggtggcggaggttgcagtgagctgagattgcaccattgcactccaacctaggcgacagtgtaagactccgtctcaaaaaaaaataataataataataaatacttagtgaattaaagatgcctgggctccacacccagaaaagctgattcagtgtctggggtaaggtcccatcacatccgtatttttctctttcccactgattctactgcctagcactgtgaactgttacacaataactgatggagaagaatttcatctttaatttttctgttttcttaatcatgtgaaaaggcaaatataaaataatgaaacaaacagttcatgaaaagaattggacagcagagatcttgagaaatcttagccaatcaatacggtcggataagatttatgaggtacgaggccatgttagccgtgactattctccttctccttgcatcatcttactaactctaaacactgtgtgatatttgactttgattctttaatcctttttaatgttgtaatatttcaggactcttatatcaggaaatgcttacttaaattttctccaaatccctcacgtcatataatatttgcttcttacatctcttgtgttgtaggatttgggaaaattctatttttcgccactggactttaattctatgaagttgcacctcatctttccctcctagagataacgtgcagcttacatgatgacttatgaatccataaatgatgttcatttgtttctgcaaactgaaaatatatttacactttggtacttctcttaggtaatcagaatgaaaatttcctagggaagaattttcatttaagtggctggagaaaatattttgcatcagtgaagatgtagtgaagagcacttgataaaatacattgtcacatttatgtctaaggtttttcctgtctaattaaaacagcagagcaggggtgttcacttactgtttcaacttgccaaatgattctgaaagtctgtgacctgtgagtatattctttcttctttctgctgcgtgaattgaaaccctgtgtgcagggtaaggagtgaatcccacttagatagtgactagcgagcagcagcaataaacctacactaaggcgtaccttcaaacatacttattctacttcttctttgcactgttaatactggcctttcctgacttcagcctggattatccattgcctgactgggaaaggcagattgttagaacataaatgaaagaaagagtcagtgctcagtttctgagctccagaataggcccttgaagctccttttgagggcaatctttgtgaaacaaagcttttaatttgccagaccctggctctctaaaaagaatgaacacatttatatctttatagatataaactggagtttcttccacaatgtaggaaagcctcctgttctacagaatcaccccctaaaataataagattttttgaaagaataagatggaacagtaaaaacctacgtaactttgtaatcaaagaactaataaaaataaaaataatcctaacgtaagtaaatattaatgtagtgaaatttccactgaccttggcacctaacatgatagttgatcaaatttttataatataaagttcatacctctttctccaagataaatttctttggagacatttacttccaattgagaccagttttatcgaaataaacaacatagacctctgcataaatcaatttttttctaaacagagagaaatgtctttgcagattcatttgcatgtgcagttttagcagagaaattgtggaaagtttagtggttctcgaagccactaaacagccacagttggcacaaatggaaatcacttatgcagtattttctctttcctgaaggttttcttttttaattctggaaaagcctgtctcagattacttcaaaatattaacatactgagaaagtcaaataccaattaatgcaatttccacattttgctgatattcttttcttctgtttgttaattctatgtatatgtatatagctatgtatatgtatttatatttatatatgtatgtatgtgtgtatatatgtatgtatatttccatatgtatgtgtatctgtatgtatatatatttacatgtgtgtatatgtatgtatggtatatatacacacacacacacacacacacacacacacacccacccatgcagtatacacgtatgtcagctcagttcttgcaagaagcagacacttcattcaagaaatttactggagggaatagacctgtgaaggagaaacggagaaagagaaggagtaagcagggagagtctttataccacaagttaggtttgacacctgggaaggggaaagaaaagaagaattgggcagaaagagtctcagaccacagctcaggtttgaaaacttctctcccaagccaatgacgagatccccgaacaagctacctatgcagaatccttcactgggcaggaatgggctggcactggtgccctcactctcctcagtcactggctggctgaagtgcgtgggagttgaggcctccacattctctggagtagcagcttgagctcttagtcaactgggctctccatagcaagctgtcttgaaatgtctgagtggctcatcctgatggctccattaacaaatatccacccaactcacctccagcacacatacatgcttgcacacatttttttctccaaattggaaggccctgatttagaaggacataaagagtatccataaataccttggaaagcagacagaagggacatttcttgctggacaaactaagaaaaggaggtatgtgaagagggtgcttataaagcatcttgaatctggagaaatcttggaggagtctagtccagaccattcaactggtgcttgagcaagtgactgattccacaaccggggtctgggatgacagtgggagctgaacctactgcaaaatgtcagtcaatcacaatgttactgaattctacacattgtgccaaccaaaaagctatattagccacactttactgtgtttctggggagagaatatctgtaaaagttgcttgtatgttgatcttttagcagaaatgttgcccccttgcaccatctttacaaataataccaacaccaaaatattagataactttcctacccagtgccctagggcatttgaaacagactgcttaagacgcttaggctgggtgggggttggggagggtgggagcggtgggggagtggtgggaggagcattggtatggaaggaaaatcacacaatgcccactccccaaatacacccttaaccttgatgaaattaaacaggaacacctgtgattcctctctgtactattcccctggaaaatgctgagttaaaccccctatttccagatatctgtcgtacatgatgttagtgactacttgctgtcacataaggagagaagcagcattattaggaagtaataaaagtacctatgttgataatacataaactccaagagaacactgtgctgtagtagtatttataaaacaatagtttcgtaaaggctctgagcatatttttttactaaattcaagcatctgccatatgattagccctcactatatctgacagaagtaataaacgaataacgtctggccacgtaccatctgcagatagctttggtttggccggcatggtcagtctttaagaaaatgagtcactataaggagcactaacagtactggcctagcactcttactagtcgaccatgaattgaagtgggtaggggtaaaggttctgccagccccattgaatcagacatgcacatctgagctggtctcttgcactcacagataacacagataaaaggaaacatatcccatgctcatggatgggtagaatcaatatagtgaaaatgaccatactgccaaaaataatctacaaattcaattcccttcaaaataccatcatcattcttcacagaactagaagaaacaatcctaaaatttatacggaacaaaaaaaaaaaaaaaaagagcctgcatagcaaaagcaagactaagcaaaaagaacaaatctggaggtatcacattatccaacttcatgctaatattataaggctatagacaccaaaacagcatggtactggtataaaaataggcacatagaacaatagaagcagaatagagaatccagaaataaagccaaatacttacagccaactgatcttcgacaaagtaaacaaaaacgtagagtgaggaaaggacaccctaatcaacaaatgatgctgggataattggcaagccacatgtaggagaatgaaactggatcctcatctctcaccttatacaaaaatctactcaagatagatcaaagacttaaatccaagacctgaaacaaaacaaaacaaaacaaaaaaatctaaaagacaatgtcagaaaaactcttctaaacattggcttaggcaaagaatttatgaccaagaacataaaaacaaatgcaacagaaacaaaaataaatagatggggcctaattaaactaaaaagcttctgcacagtaaaagaaataatcgtcatggtaaacagataacccacagagtgggagaaaatatttgcactcagttttgttacctgccttgtccttctagacatctgtgtctaagaaataatcaaaaagtgtgtaatccaaaagagggtgtgttctttttcccttttcccagcagtctgtccttgctaattatatttagaatgagttaaatattaaagattgcattcccagagcacacagccttgcagaaattgaccatagacattatgcatagtgggactagacgaagatttaaattcttctgtacactgaaaggtaattttctgcatactgaaaataatttagacatagtaattgagactgtatggcattcatcattctaaaaatcctaaatttagtagataactaaaagtcaaatactttatgatcaaatacctttaaaataattttgttttattatagaattacatagaaagaaaaaatctacaatctatttcatttttaaaagagaagtttagtgtttgttatatatgttgtcgtctttgtcatcaaaaaccagttgaaaaacaggctggacgtttgcagacactgagatacccaaaacccagttaatacacagctgccttcccaatcctcaatttaattttaccttcatccccattttagtatcaaatcctgggaatcttcagttcagacacctctgcaggtgccacacataactaacctttcaataagattaactgccagactgtgacatttgatgtgtgataatgcaaggctttgtgaattttaaatgattctgcagatgaatttgagatacagtaaagccttcattagatataatttaaggaccaaccactaaacaatcttaattgcagaaactcttaaagatataagcataaaaaagttaatttgtggaggagagtcaaacatttggacatttttcacggggtatcctaaatgacaagacttatacagacagaggaactttagttgtcatcatcactatggagcactttgtacagaacacctactgagagaagaaaaatggtgcaatactcttcctttacccactgaaaaagtaataataacaacaatgaaagtagcaaagactgattgaaaatagtttatgctaggtactatcctaagtgctttatgtatattaattccatcctcataattatccagtcacctagcttcttttgagttttcatattagaaaggaagcaactgatgctcagagaatgtaaatgtctgaaataaagtggaagccaggcatgatggctcatatctgtaatcccagtactttgggagaccaaggcaggaggatctggattgaggccaagagttcaagaccagcctgggcaacatggtgaaaccctatctctacaaaaaatacagaaattagccaggcatggtggtgtgcccctatagtccctgctactctggaggctgaagtgggaggatcaattgagcctgggacacggaggttgcaatgagcaaagatcatgccactgcactgcagcctgcgtgacagggtgagaccctgactcaaaaaaataacaaaacctcaaaaacaaaaaaccaagaagtggaacagaaagtctcatttaatctgttcctttgactccagggccaatcttttaaaaccctgaacaaatgttcccgaaattttcctgatgtaaactaagaatccccctgacatattaattctgtaactgtgaagtaggcctggggatctaaagtattttaggcaatgttgaacgcattggccaatgttgctatctagctaatgagtctactgccaggaagataatcctaacacccactagcacacccaatccacaaggctttatgaccatcaatataagcaaggcaaaatataataatttcaagatatgaacacataagtcatttctggctgacatttgagggatgtttacttcattaggaactagtaaagtttataacggaacaaagtatttaagaataccttttcatatttacagaatttttattttggatgtccattagatatgctaaaatttataatgtttttatatatacttcacttgataacatcctcacatcaatcctatgtttatgtcatttagttctcattttgcagatgggtgtaaaatacatttgattactttcaaataggaagaagaaataattcactgactgtccccttgttttcacttgcccaacagaattcagaaaaccagaccaaataagaacaaatcatatgtattatttattgcaaataaaactggaagggaaagtcaagcagcacactttggtgtggcaattatgaaaatgcatccttgggttccaagatggccgaataggaacagctccagtctaaagctcccagcgtgagtgacacagaagacgggtgatttctgcatttccaactgaggtaccgggttcatctcactggggcttgtgggacagtgggtgcaggacagtgggtgcagtgcactgagagtgagccgaagcagggtgaggcatcgcctcacacaggaagcacaaggggtcagggaattccgtttcctagccaagcgaagctgtgacagacagcacctggaagatcagggcactcccaccctaataccgcacttttccaatcatcttagcaaacggcacaccaggagattatgtcgcatgcctggcttggagggttccccacccacggagcctcgctcgttgctagcacagcagtctcagattgaactgcaaggcggcagcaaggctgggggagggatgcccgccattgctgaggcttgagtaggtgaacaaagcggctgggaagcttgaactgggtggacctcaccacagctgaaggaggcctgcctgcctctgtagactgcacctctggaggcagggcatagccgaacaaaaggcagcagaaacctctgcagacttaaatgtccctgtctgacagctttgaagagagtagtggttctcccagcaccgagtttgagatctgagaatggacagactgcctcctcaagtgggtccgtgacccccgagtagcctaactgggaggaaccccccagtaggggcagactgacaccttacacggctgggtacccctctgagatgaaacttccagaggaatgatcaggcagcaacatttgctgttcagcaatattcactgttctgcagcctccgctgctgatacccaggcaaacacggtctggaatggacctccagcaaactccaacagacctgcagctgagggtcctgactgttagaaggaaaactaacaaacagaaaggacatccacaacaaaactccatctgtacgtcaccatcatcaaagaccaacggtagataaaaccacaaagatggggaaaaaacagagcagaaaaactgaaaattctaaaaatcagagcgcctctcctcctccaaaggaatgcagctcctcatcagcaatggaacaaagctggatggagaatgactttgatgagttgagagaagaaggcttcagactatcaaacttctctgagctaaaggagaaagtctgaactcattgcaaagaagctaaaaaccttgaaaaaaaaattagatgaatggctcactagaataaccagtgtagagaagtccttaaatgacctgatggagctgaaaaccatggcatgagaactatgcggcaaatgcacaagcttcagtagctgatttcatcaactagaatagagggtatcagtgattgaagatcaaatgaatgaaatgaagtgagaagagaagttcagagaaaaaagagtaaaaacaatcaaagcctccaagaaatatgggactaggtgaaaagaccaaatgtacgtctgattggtgtacctgaaagtgacggggagaggaaccaagttgaaaaacactctgcaggatattatccaggagaacttccccaacccagaaaggcaggccaaaattcaaattcaggaaatacagagaacaccacaaagatactcctcgggaagaacaactccaagacacataattgtaagattcaccaaagttgaaatgagggaaaaaatgctaagggcagacagagagaaaggtcaggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctaccctaaaagagctcctgaaggaagcactaaacatgggaaggaatgactggtaccagccactgcaaaaacatgccaaattgtaaagaccattgaggctaggaagaaactgcatcaactaacgagcaaaataaccagctaacatcataatgacaggatcaaattcacacataacaatattaaacttaaatttaaatgacctagatgctccaattaaaagacacagactggcaaattggataaagagtcaagacccatcagtgtgctgtattcaggagacccacctcacatgcagagacacatataggctcaaaataaagggatggaagaagatctactaagcaaatggaaaacaaaagtaggcaggggtttcaatcctagtctctgataaaacagactttaaactaacaaagatcaaaagagacaaagaaggccattacataatggtaaagggatcaattcaacaagaagagctaactatcctaactatatatgcacccaatacaggagcacccagattcataaagcaagtccttacagacctacaaagagacgtagactcccacacaataataatgggagactttaacaccccactgtcaacattagacagatcaacgagacagaaagttaacaaggatatccaggaattgaactcagctctgcaccaagtggacctaatagatagttacagaagtctccaccccaaatcaacagaatatacattcttctcagcacaacatcacacttattccaaaattgaccacatagttggaagtaaagcactcctcagtaatgtaaaagaacagaaattataacaaactgtctctcagaccacagtgcaatcaaattagaactcaggattaagaaacccactcaaaactgctcaactacatggaaactgaacaacctgctcctgaatgactactgggtacatacagaaatgaaggcagaaataaagatgttcttggaaaccaaggagaacaaagacacaacataccagaatctctgagacacatttaaagcagtgtatagagggaaatttatagcactaaatgcccacaaggcaaagcaagaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaaatcaatgaatccaggagccggttttttgaaaagatgaacaaaactgatagactgctagcaaaactaataaagaataaaagagagaagaatcaaatagatgcaataaaaaatgatcaaggggatatcaccaccgatcccacagaaacacaaactaccatcagagaatactataaacacctctacacaaataaactagaaaatctagaagaaagagataaattcttggacacatgcaccttctcaagactaaaccacgaagaagttgaatttctgaatagaccaataacaggctctgaaattgaggcaataattaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcatcctgataccaaggcctggcagagacacaacaaaaaaacagaattttaaaccaatatcactgatgaacattgatgcaaaaatcctcaataaaatactggcacaccgaatccagcaacacatcaaaaagcttatccaccatgatcaagtgggcttcatccctgggatgcaaggctggttcagactacacaaatcaataaacataatccagcatataaacagaaccaaaggaaaaaaacacatgattatctcaatagatgcagaaaaggccttcaacaaaattctacagcccttcacactaaaaactctcaataaattaggtattgatgggatgtatctcaaaataataggagctatctatgacaaacccacagccagtatcatactgaatgggtgaaaactggaagcattccctttgaaaactggcacaagacagggatgccctctctcaccactcctattcaacatagtgttggaagttctggccagggcaattaggcaagagaaagaaatacagggtattcaatcaggaaaagaggaagtcaaattgtccctctttgcagatgacatgattatatatctagaaaaccccgtcgtctcagtccaaaatctccttaggctgataagcaacttcagcaaaatctcaggatacaaaatcaatgcgaaaaaatcacaagcattcttataaaccaatgacagacaaacagagagccaaatcatgagtgaacccccattcacaattgcttcaaagagaataaaatacctaggaatccaacttacaagggatgtgaaggaactcttcaaggagaactacaaaccactgctcaacgaaataaaagaggacataaacaaatggaagaacattccatgctcatggacaggaagaatcaatattgtgaaaatggccatactgcccaaggtaatgtatagatacaatgccatcaccatcaagctaccagtgactttcttcacagaattggaaaaaactactttaaagttcatacggaaccaaaaaagagcccgcattgccaagtcaatcctaagcctaaagaataaagctggaggcatcacgctacctgacttcaaactatactacaaggctacagtaaccaaaacagcatggtactggtaccaaaacagagatatagaccaatggaacagaatagagccctcagaaataataccacacatctacaaccatctgatctttgacaaacctgacaaaaacaagaaatgggaaaaggattccctatttaataaatggtgctgggaaaactggctacccatatgtagaaagctgaaactggatcccttccttacaccttatacaaaaattaattcaagatggattaaagacttaaatgtcagacctaaaaccataaaaaccctagaagaaaacctaggcaataccattcagaacataggcatgggcaaggacttcatgtctaaaacaccaaaagcaatggcaacaaaagccaaaattgacaaatgggatctaattaaactaaagagcttctgcacagcaaaagtaactaccatcagagtgaacaggcaacctacagaatgggagaaaatttttgcaatctactcttctgacaaagggctaatatccagaatctacaaagaactcaaacaaatttacaagaaaaaaaaaacaaccacatcaacaagtgggcgaaggatatgaacagacacttctcaaaagaagacatttatgcagccaacagacacatgaaaaaatgctcatcatcactggccatcagagaaatgcaaatcaaaaccacaatgagataccgtctcacaccagttagaatggcaatcattaaaaagtcaggaaacaacaggtgctggagaggatgtggagaaataggaacacttttacactgttggtgggactgtaaactagttcaaccattatggaagtcagtgtggcgattcctcagggatctagaactagaaataccatttgacccagccatccctttactgggtatatacccaaaggaatataaatcatgctgctataaagacacatgcacacgtatgttcattgcggcactattcacaatagcaaaaacttggaaccaacccaaatgtccatcaatgactgactggattaagaaaatgtggcacatatacaccatggaatactctgcagccataaaaagatgagttcatgtcctttgtagggacatggatgaagctggaaaccatcattctcagcaaactatcgcaaggacggaaaaccaaacaccacatgttctcactcataggtgggaattgaacaatgagaacccttggacacaggatggggaacatcacataccggggcctgttgtggggttgggggaggggggagggatagcattaggagatatatctaatgtaaatgacgagttaattggtgcagcataccaacatggcacatgtataaatatgtaacaaacctgcacgttgtgcacatgtaccctagaacttaaagtataataaaaagaaaaaagaaaaaaaagaaaatgcatccttgctgattatggtaatccacatttggtccctcccacattcacagcccacatcctctcaccatgcttagcaaagcctggaccaaacagcacattaagggcccactaatacaaatagtcaggtattgccagattattttatgcaaagctttagaaatctgtgtttaaaaattaacaaataacaaaaacctccttagttgagaacccctgctttcaacagtgttagcatctctgttgagaagaattagccattacaaggtataaatatatatatatattaaaattagatatatatatgtgatgtatataatatacatatatatatttgagacagtttcaatctatccccgaggctgtagtgcactggcacaatcacagctcactgcagcctcaacctctgggctcaagtgatcctcacaactcagcttccagaatagctgggactatgggtgcatgtcaccagcctggctaattgttttcaaattttttgtagagaagaaggtctcacaatgttgcccaggctggtctcgaactcctgacctcaagcaatcatcccaccttggcctcccaaagtgctgggattgcaggtgtgagccacagtgtctggcttatatttcttatttcatgagaaagaaacacttaacattgaaaaattggaaggtaaatttaagtgtaaatataaaatatgagactcattcatgatccctctacaaataggtagcccatgtttatattttggtgtattttgttattttaggcatagaacatgatctgtgcacaaaactaaaagaataaaacatgggaatttgggttgatgttggtttaatccttttcagtagtggagagaaggatgtgtttgattgtttacaggtaggaaaagaaatatgtcaaccaagtgtccctttcttttaatttgtgccacagaacaatgcatagttgtaattaaaaataaaaatttttattgacatgtaattcacatgccataaaagtcaccatttttaagtttacaattcaggaaaaaaaattttttaaacagaaacaataacttgattgtttattaacaccttttcatgttgctgtgttctacaatatcagttttaatgattttatagttttccattgacagtattaaaataatttaatttgtcttctatagatatttaagttgtgtcatgttttcactactacatacaatatttaaatcaatatcagtgtaatgttatctttcatgtccatttttatttctatgttatacattctaccacagggaatctgtttcaacaggcatatacatttttaacctaaagaaaaaataagttaaattcttaggttttattttcaaaattgccaaaggcttttgagaaaaaggagagtactaaataaatgatacacacacacatacacacacacacacattgatagatgatagatagatagatagatagatagatagatagatagatagacagatagacagacagacataactgaaactgaacagatcctaaaactgtgaactgatgtcgcccaagctggtctggaactcctgtgctctatatactatagagggtaggatcttataatatccagtactaccttggggccaagtatttgataagacagagtatgaagtcaggaatatctgaacgaatctaaattttggctcttccactaactagttgcctgatttggaacacattccaattttctcatgtataatatgtgctatggtttggatgtggtttgtgtctgccaaaacttatgttgaaatttaattggcagtatgctggtcttgggaggtggtgcctttcagaagtgattaggtcgttaaaatagatcaatgtattttccacaagactggttagttcttgcaggaatggaatagttccagaaaaagtggcttgttactaagcaggttgttacacactccccttctcctgtagctcctccaccacattgtgtgacagcacaaggtccctgccagaagctgaacacatgttgttccatgcttcttagccttcccagacttcagaattgtgacccacgtaaatatcttttctttagaaattacatgaactcatgtattctcatgtattctgttagggcaacacaaagacaacatcaatatcaaacaaagccatttctgaaacacattaagtactctaaaagtgatgcttggtttttttacattttagtaataataatcattagcacattattattaatgttatttaactatatgctttccaaatataaagttatattctgtaaggatatatatacatatatatacacacatatatatatacacacacacacacacacacacacacatatatatatatatatatatatttttttttttttttttttttttgtcagtgtctagctctgtcgcccaggctggagggcagtggtgcgatctcagcttcctgtaacctccgcctcccaggctcaagcaatcctcccacatcagcctcccaggtagctgggactacaggtgtgcaccacgatgcccagctaattttgtatttttttgtagagacagttttgccatgttgcctaagcttgtctggaactcctgagctcaagcaatccccccgcctcggcctcacaaagtgctgggattacaggcctgagtcactaaacctggcctataaggatattcttatatggtgtttagcatgaagaaattcttggaacaaatccatctactttgttacattattttctatgggccagtctttcaagttactaatgtaatttttgtgagtgaactattagggggtgattattaggaaatgaaaaaaaatttaaatatggcttgatacctttaatatgattcaaaagacataatttctaaagcagaagcagaaagccaaatgagataatagattatgatatgaaaatgcaacttcataagatgaaaaggaaggtccttgtaagaagaaatacttgcaagaaaactaaaaacatataaacggacttaagacaccattggagtcaggtttgaacagagttattaatgctgcaaactaagtcaatgatatagagacatatggcagccaataatatatttaattttttaattgatgtttataatgaaattgacctttaattcaattatcttagactgttcttatctcagtttggtactagagctatagtgacctcatcaaataaattaataaacattccatcttcttctatattcagaaacaactcattaagacagggtcctggaattttggcagtgatcgtttgtgaagccatctgagcttaatgatttttcaataaaggaattttagaatatcactgcagtgtcttcaacagcttgggatctgttcaagattttatttattttggatcttaaagtggaatttaatactttttttagaaagttgtatatttatcttagatgttaaaatttgtggctgtacaattattcataatattttaaattttaaatctatatatgttttattttctttctgttctttgtgttcttttctttctttttccttgtttagtcatgtcagagatttgtctattatatagtatgcataaccatttattctttttgtgttattataagctatgacattaggttttgactttattgttttaaaatgttttatttaaccttattttttgctttcttttatattgtttttcgattgtttccctattgtttttcttttgatattagaaactgacaatttaatgcattttacgactgaaaattaagtctcagactttcttctttactgtaaaatgtagtcagaacgactattaccactcacaggtgctactaatttagccatattccttacttatctagtctgtgtcttcattcagccttaaataagttgtgatttctctcttcaaggatcattttataatatcatttttttctattttcatatctaattttagctatccttttgttgttttttaatctcactgcaatttggtaaaagaacataatcaatggtggtggtttatttgtagctgttttgtgccacgttggagtctttcaaatttactcaggctttccttgtggcccagtacacgcctgacattttgtgaatgggccatgaatattaaaaacataatgcgttgactgggcgagctggctcacgcctgtaatcgcagcgctttgggaggcccaggcaggcagatcacttgcggtcaggagctagacaccagcctggcctaccaaatggtgaaaccccgtctctattaaaaatacagaaattagctggacagggtggtgggcacctgtaatcccagctactcaggaggctgaggcaggagaatcgcttgaacccgggagaaggaggttgcatgaatcgagatggcaccactgcactgcagcctgggtggcagagtgagactcctccattaaaaaaaaaaaaatacccataatgtgttttgtctgttgtatctatctatctatctgatttacctaccaaccaatagcgctagctccatattagataatataatttgtcatgttattcatattttctgtctttgcatatttctgtctagtcaggttccaagtggggtgtactgaaatatagaactgtaattatgaatgcatgttgttctcaatgtatttatataacttgatgttttatatatttgagactatgttgaatgatcatagtgacgtgctggatcaagtttatactattaatagctcacaagagccaattgtttattttcaggaattttatgagccagttgttacacataataatttttaaaaattaaattatattaatttatgattaagtacagtatagtaaaaacaaaggtaataccaaaatccatacttcctattttactacatttacaaagaaaaaaagatatttttacaattcacaggtctgccagacaccagcttattcaaatgatcaagcacagcatcaccaacagtagaacaaactaaccttaggtgtctctctagtggtgcaatgagactaactgacaacgccttggtagaagcatctgtgtgtctaaaatcaatcttatctagagaaaagagatagatatgaactgttacactatagactaccagacaaacctatcctaaaaaatatgaggtagtaacttcctgtggttttattttccaccaccctattgactaatgatgctgagctcccttgttttgtgaggttactggccattcatatatcttcttttttgaaccatttgtttacattattttctcatttttaatgggttgttccttttcctattgctgatttgaaggagttccttagtcagaggtatgcgtacttctttgtcagatgaaccagagtggagtgctttgttggttatatgtattagaaatatttttccccagtctgtggcttgcctatccatttttgtcatatgtctttcgatgagaagatcttatgctcctagaacatgctcccgctggtccttgattcagactcagtgtataatttctgtgtcccaggctccaaaccagccctttctctacaaggtttgactccttcccacccccaaagataatgctattagaacccatgttctggaaactagatgttcttgttacaatttcatttaatcctttcagtgtaaagaagtagaaaatgtttaaagtttagaaatcgtgaatttatgttatcactgctaattctattgcaataacacagagattttcctccccttccttaattctatattggcatctcttttctctcattgagaacattggctccaaaatacaacagtatatttattcatttattctatcatttaattcatacaaaatactttcagaattaatatattcattctctctaccaacaaaaaacctgctgtataaagtttaaactttctttctaattaattttgagactgaattctgatcaagtataacctgaaaccttcttttattctggtgtttgtattatacatatatattaatttgtttttcatcgtattcaatttcaggagtttcttttttgcatttgccttaaatttattttgtttttgaatatgtgaaacatctatgtggttcccaagtcaatacaatataaaaaggtaaactgagagcctcatttgccttctacattcctcccactgacccatctacaagtacctatttaaattagtttttgtgttgttatttgtgtttcttaataaatttttttaagtgtgcataggtacatgcataacacacataaaataaatctgattatgcatatgataatctgaagctcctctcttttttctatggaaggtttactctatatacctttttacactgtaatcttgctttgttatttgatattatatagtggaaatcactctttatcagttcataaagatcatatatactctttattttttaatgcctacacagtactgtactgtgtgggtataccatagtttactcaccttgaacgacatgtagatttttccagtgttttattaccaaaaatagtgctgcaatgaataaccctgtaggaatgttgctttgtttctgtgcattttttaatactgataaatctttactttaaaaaatggccttatcactactctcaagagcccacaatatttcaaaaattacctcattgatatacatacattcaacattgcctattagaacaaattaattggcatactcctttgaaatctgtctaaagtaaataaagatatatgatgtgaataaaactagtcatcatactagaacgtgatttgctatttactttgttacatatgcagacaaattttcatgtgagaatattattccagccacacctaactcttgtttttatgatttttctgggaaaaatatggtccaaattctaacagtatctttttaaaaatatcttttagacatgtttaatgctaatttgcagtttcttgtgtataattaattaccaggggatccataaacatggctgtatacagaaatcaaacaaaaccttaaaaaaaaatacaaattcctgagtctcattaaagtatgcagaatcggaccacctaggtctgtggattgagcagttcatttataccacatttggtaactcctatgtggtaaatatagggaaagggactagaaaattagataaattgtcacaggcagaggtggtcatagaatcttcctagacatggtgacctttggttgggttttgaaagcagagaaatgaagcaggggaatatgcttctttttaaatatgtccacaaatttttctacctcttccccattcaaaagtggagtctaattcacactccacttacgtggagttttatttagccacttgcttctagtgagtagagtatggaagaattaatggaattagtcttccaacagtagatcgtaaaatgccctgcagcctttcagccttttagattattcactaaagggaaagtaggctgtcttgtgggatcctgtggagaaaccaatatgataggagctgaagacttgtcaagagccggaggaactaaggcttcctttctacaactatgttggtgagccagtgaggaggtggaaccttcagcccaggcgagcctttaaataactgaagatgcagatgacatctggactgcaacatcatgagagaccttgagccagctgttctcatgactggcccacaagaaaataagattaagacaatgtgatgttttaaggtgctaagtatttgggtaatttgttatgcagcaatagaaaactaatgcagacagtcaacagggttttcagtatgtggggagtttgagagaatggatgtcatgtaagacaaaggaagaatatattatatataactcctataattattcacaacatttctgacatcaaatgtatgggttttctacaccaagtaattctccaattccctgctgtcaccaagtgggtatcctacaatttaattaaattctgacactatccagagtcagtgctgacaccaaaggtaaagagatcagtcccacaagactgccctccacttcagatgccagtcacaaatagtgggtcaccaggttacccacacttctgtctaccttgcctacaaatcagaggttcccattacctcctcctcgggttcaataatttgctatagtagtagctcccaggaaggtggttactggtttatcataaaggatagaaattaacagccagatgaagagctccatagggcaaggtctggaagggtcctgagttcaggagcttctgtccagtatgatttgagatgtgctaccctctaggcatgtggatgtgttcgtgaactagaaaactctctgaacatttttatttaggagttttatggaggtttcattacataggcacaattgactaaatcatcggccattggtgattgaattcaatctccagcctctctctcattcccaaaggttaaggattagggctgaaaattccaagcttctcatcacttggttggttcctctggcaaacattcctcatcctgaagcaatctaggagccccatcaagagtcatctcattagcatgaactcaaatatcacaatgtcgtaatatacaaacataacactttagtaaatgagaatagagcattaaagttaaatgacaacaaatattgaactagtgacataatatatgaagtctaacagagtctaaaattttttgacatttgtgctctttgattatataagtacctacataatgtcttcaattttgtctctttaaattttttttttattttattagcttttgggttacaagtgtttttttttttttttttctccacagatgaattgtatagtggtgaagtctgagaatttagtgcacccttcacctgagtagtgtacgttgtacccaatacatagttttgtatcctttgcctccctcccatcctctgttttctgagtctccatagtccattatatcactctttatgcctttgaataccaatagcttagctcccacttataagtgagagcatatcatatttggcttttcattcctgagttacttcatttagaataatggcctccagatctgcccaagttgctccaaaagacattatttcatttttttatggctgagtatttcatggtgtatatatacaaaattttctttatctactcattagtcaatgggcacataggttggttccatatctttgcaattgtgacttgtgttgcaataagcatacgcatgcaggggtctttttgatataatgatttattttcctttgggtagatacccagtagtgggattgctggagcaagtggtagatctacttttagttctttaagaagtctccatactgctttccactgaggttgtactaatttacattctcaccagccgtgtataagcattcccttttcaccacatccaagccaacatatattattttttgactttttaataatgtccgttcttgtaggggcaaggtggtatctcattgtgctcatcagcctgacagcttgtgatattgagcattgtctcgtatgtttttggccatttttatatcttattttgagaagtatctgttcatgtcatttgcctactgtttgatgggaatatttgtttttctgttgctaatatatctgagttcattgcagattctggatattagtccttcgtcagatgcatagtttgcaaatattttctctcattcagtgggttgtctgtttactctgatgattatttcttttgctgtacaaaagctttttagtttaattaggtcccacttatttatttctgtttttgttgcatttgctttcagggtttaagtcattaattctttgcccaggacaatatccagaagagtttttctaggttattttcaataatttttatggcgttagggcttagatttaagtgttttatcctcctagagttgattttcttatgaggtgagagatagggatccagtttcattcttcagttggctagccaagtttcccagtatcatttattaaatagggtgtcctttcccgtttgtaaaagctaattgaaggaggatttttactatgactacaatcaagaaaatcattatgcaattctaatgatgatacgttcaagaaaggtacccatagaaacagaaacaacactattttaaggtatgaaaacaaactagggtcaatatggttaaagagaagccaaaattgaatggaagttgatttggaatttctcattttggaggaaagtatatggtgtattaaatatttattgttttattaatttaatattttcttccaaatgaaaatctcaatatttcatagactaatgtgcagaaatggttatagaacaagtttaaaactctatttgatattttactgagattaggtactattcgttttgcaactaagtaagattaaatcatttttattacttttttaagtagaagtccaactaagccacaaatatgcaacaacaaacatcttaactgctttttctttaaatgagattgtgaaaacatttcccaatatacttaaggttttttggttccatttttgaaagagggttgtttttctgactaaaaaggctttcaaagataattataagcacttatgctccctttttcttattagagatcttagacgggagatttaggagaaattatcagtaacagcacttgaagtatcctgaattgaaactcagttagctgagaattttgactaatttattccctggtcccacttgcatgatggatggttttttacaatatgttgatatttttaaggcaatgccagatagtggaataattattatcagatgaaaacccacaattgtgttgtgataagatatttgtcatgaaaatcatacaaatgcatgttgaatataaaattgtcttaaatgagttgagtgatcattttataagaaagatagattcatttaattgagccctgcttggggaaagtcaatacagagattgccaatataagcaattacatgttaaatggaatttgtacagaacatcggagcgtagattttgcctttcaatgtttttgcataattgcaaatgattaccttccaaagagacaacttgagctgcaagtcatggaaaacgtcagtgcttcttattgctaacaggctcaagtgagagctttaagtattggatggtaacaatagaatcaaaggataaagagaacagtgagagacaatgttcaggtttcttgcctgacatggaattacatttaatgattgaatgaatatgcttgttaaagaaaaagcttcttacctcaataacttattgcaatttttaaatttcctatcatgatattcttctatgccttgagtcacttatattacatcttcttctacctctgtgcttcatgaaaaaagggagataatttagttcctatgttagatggctaccagaaagtcaatgcatcttgtaaaatctagaataaataaattccatattttttaattcattgaggggcacagattaatattcaagaattgtttacatggcttcttgtttcattcatttagtaagtgttgagtattttgtagttgctatgtactaattcccatactaggtgctaagatggaatttatccaaaaatgtttgaaaagcaaaatctacagtaaaatgtattgaactctaaaagtatgaatacagcacactctccatttccagggtgccttacagagcaagagaggagaacaacccccccccccacaaaaaaaatcgatactttttatcttgtataacaagtcctctgatagaaatgttaaccactctacatctacagtactaattatacttctaatttgtacttgcagataagaagatagagtctgagtttaaaaaaaagggaatattcactctctcctgtagtactgaacattttactcaaatgattaaaggaggctttttctttaaaaatttcaaaatatcattgtatttcattccaatatgcaaatgcagattaaaaccttttccaagagtatattgttcttaaatttctggaaaagtttttgagggtcatgagagctcaagggaacaactaaaatgtagaatcctttaaataacaacagatgtctaagtattttatctccttttaccacatgaactatttgctgacttctgtctgtgtatcttcaactagtatttgtaaagcatgtagctgattaggtcaaaggaacttgaagttttattatttatgctgaacataaattgcaacataagtctggataggatgtgatttacaacattaccatagtaactacagttgatatttttatatttaggtttgttgttgtattgcctataatagatttaaaatcccaatatgttttaatagaaaacagaagtaaagtatctacatatcaaatcacaagagttaattgcctggtctgaagtctatggaatagggctagaaatgattagaaatatttatgtgatcttccttataactagagagaaaataggcagaaatagggattctaaatcaataattctgaaaatgatacaaatagacagttgttcccaaagaaatatgtaggtgacgtgaaatctggatgagcatcattctgctaagtttggcccttttctagttgtcataaccgctgatgcaattggcatccacacatcaaagcattctcatatctgttcacctccagtctaaatgaagctccagtttattctcattggcctatgcagcagaaaaggagtggatatgtggcaatattccgatgtattatgtcagcataagcaggtaatttggatgtaatcccgaaaactcaccccttaactaagaagttgtggagtagatttgtgtctatttgttcaaatatgttactcactgtccaatcagcctcttaatttggagcataaagcctatgatctgtggagaattagaaattgtttgattgtagatactgtacagcaacagctctatactctagttctaaatactatactaaggaaattagaggtcccggaaaaacaagtacaaggctattcctggattgttatttactccaatacattattgcaactacctaagattctggtactagaaaactggtaggaaaaattgtgatatattcatatgatggaatacttatgcaaacatcacactatgtatttttaaaatagttcattacttgggaatatgttcattacataatattaaatgaaagtggaaaacacaatctgatttaaatttgtaaaaataaaactgaatatggaaatatgagtatacatttaaattcaacacttttctgaacaaacaatatataccagattgttatctttagttgatgtcatgacagctgatttgtattttatttttgtaaattgtgagtgctaggtactctttctaaagtgatcacataatgttttaaacaaattaattattaacaaagtggaggtatatagggatgttcgagtaatttattctacagaaacattcaaaagtcctgtataataccaaataagaaagcatatctgatatacattgtctaatgctatagagaccacacaagagtaaaccataattatcccaggcaacatttctttccctagaaattcaacagctgctggttttccagagtcatataaaaatgtattcttcggtgataaacaacaaattaaaatttaaatcacatcagaaaagccaaagtcaatttggctgaacccttccctcattaatttggtcacagtttgggggaaatagctcctaagaacatttgagaagaaactcccaaatgcccaactcctaaagtgttaaatcaggattgcagttgaattagaggcaccatccttgatctgcatttcctgacaagttttatggtgtgcttagatcataaaatatttaaatctccccagtgcctgataggttgctaagagcaaaatagttgctttaaagaaatatacactgatgcatagtgattgcaattttcactaaatgaaatctatctcagcaggttgattttgtcactacgtcttattctcctagactctcttatctaatcaaagtaaagatctgacctttcacacagtactagatccaattaatgctttgtagttgctacatctctatggagaccctcgatttctacttgtttgtactgattcactataagagctataacttacattttataattaagaaataaataacaggatccttggtatttatccaaatgagttgaaaatatgtctacacagaaatctgcacctgaatgtttatagcagctttattcataattaccaaaacacagaagcaactgagatgttatccaatagaggaatgcatttttaaaaactgtggtacatccacaaaatgaaatattatttagcaatatgaagaaataagcaatatgaagaaaaaagaaaaataagaattttttttcttttgctaagaaagagaaaacaatctaaaaggccacatactgtgtcattcctactattctgggaaacacacaactatagaggcagtaaaaagatgactacttctcaggggttaggggcaggtaggaatgaataggtatagagctcaggatgtatttagaatagtgaaactattctatatgctgttataatggtaaatacatgtcattgtacatttgtataaaaccatagaatatagaataccaagagtgaaccctaatgtaaactatgggttttagttaataaatatttattaatattggccctttaattggaacatgcaccatactaatgccagatgttaataataggagaaactatgacaaatatgtgggagaattatatgaaaaatcttgtaatttatgcttgatttttctgtaaacctaagactaccctaaaaaaggacaatctatgaaataaataaataaaaggaaaggaaagaaaaagaattgagaaaagacccttttatgtctattgtgttgtacaacaagtaatttagggctgaaataaactattggtgtttgtatatttatcttattttaataatttttaactcatattctgctattttattaaatagttatagcatttttatataacgacaattgaatgtctttttacacttcaaatttattttatctttcccctctttcattccattcttcctccttctccctcctcccttcctttgttccttccttcattctctctctctctgtctgcaatattttgttttgtttttctataatgattttgaaatgtcaatgacagaagtaattttctttgtccagtgcattttaggaacatgaggatgggaaatatcttgagttaagggattgagctttaggttcatcatgagtattacaataatctatatattattcctaaatattagatgtataaagtactgcatcaaaaactgatagtaaggagaatatcagaaatattataaagattgatttatactggtacattaaaacacaaagtacatttttatgtggatgttaaagaaaatatttttataggaaaaaggtgaacaattatggactagaaaagttgatatataagaagatagaatgtactatcataggtttcatagtgacattttgttaagtaatatataacttagtgatgagtgcaagaaagggaaaccagtggcttgtaagaccgagggttggatttgaaagttcacacgtcgtcaaaaatacctgatatattaaatccatctgtgctctgaaaaatcaaacaaataataaaagaggggaaaaggaagaatctgacatcaaattcaacattttagggagttctgcaaatgggtctacatgagaaacacgcttctggagaaaaagaaaaaattttgagaagaaaccaaacaaacaaaaacctttaaatggctaccttctaaggtgaagaaattccagatcctatctcagggagaaatgggtcaaaaaaagggggaaaaaagagagagagagagagagagagaaagagagagggcctctaatgtggtgctgttaagaaagtccactgttgtttatgttcactcacactattattttagggaagcatccttccattcctaattggataaaagatgtctttcaatagaaatatcttgtcttcatctgttttgtgttgctataacagaatactgcagactgggtaatttataaagaaaataagtctatttctaatagctatgaatgttttgaagtttaatttcaaggtgctggcatctggcgagggtcttcttgccaagtcatcccatggcagaaggaggaagggcaattgcccacaagacagcaagagagagtcaaacttgtatttataacacgcccaatctctccataactaactctctccaacaatgatgacattaatcccttcatgaaggcggaggccttatgatctaaccaccacttattagagccctacctcccaaaactgttgcactggggattaagtttccaacacatgaactttgagatacacaattcaaaccttagatatttccgtaatcaccaatcaaagtcataataaaatgttccttcattataaatcaagataatctttttaaaaaatttaatctatgagcataataaattgttattaatacaattttgctgaagttgaatcatctttgcacatctggaattaattaattcctggtacattttttaaaacatgctgcctatttaaattttgtttactttctttatatctcttataagtgaggtatatcagtggctttcctttttctgctaccttatcaaatttgagatgtggctatgctaatcttattagatgaaaacaagagcttactctcttttctatgccattgatcaatttaaataacacgagaataactcattcctcatagatttgatatatcttgcctgtcaaaacattaagtgacaaaattctccactccttgtggttaaggaagatattttcacatacttaccatgatcatcccttcaaaaatctcttctagaatattttcggagaattaagatcctgcttaccagcatctttccttcttacacatcctaaccacatcagcccttttaatgtccattatttcccaaagttggatgacggaaggatcaaattatttttgtctcataaatcatttcctaagaaccgatagtataaaactaatttaaacttgtacattgaagactggcaagaagggtgactggttatgtcatcaaaataccagttacatttttaacaaaagaattcaatgccttcacttcaagaaataaatgactataaagtgatatttgagaatttataacatgttttaggtgaaacgtaaaggtagagaaaaaatgtttggtcgggagatggctaatcagacataggtagagggaaaggcagccttgctttctaatatattaagagtatttcagaaacaggattattgaagatttctttattttatttttaaaacataccaccaatatttttcattttgctcagctagcctaatgctgactgtttctccaggatctcttctgttaggtgaaaaatggaatacatatggggtgaggttggcgggaaggaataatagaaaccaaagcagaatgaaatgcaacaaaaccacagaaactgtcaataaaaaattgcaccagataagttaaagcagacaaagaagacttcattcaggactattacaatgggaaacagagatggaatgcaactcagttgaaccaaaaagtgggaaagtgtttaagcactggaagagttgtgtgtttgctaattgatgcttattaaagttagagtcctactttcctacatactaggagaaagggctgaacagaataggtaacccagaaataaacccaaatacttaacagccaagtgatttttgacaaaggaaacagaaacataaactgggggaaaggacaccctattcaacaaacggtgctggaataatttgcaagccatatgtaggagaatgaaactggatcctcatctctgaacctatataaaaatcaactcaagatggatcaagcacttaagtgtaggacctgaaattataaaaatgttagaagataacatcagaaaaacccttctagacatcgcctcaggcaaggatttcatgaccaataacccaaaagcaaatgcaataataacaaagataaatagctgggtcttaattaaactaaagagatttgcatggcaaaaggaacagtcagcagagtaaacagacaacccacagagtgggagaaaatcttcacaatctgtacatctgacaaaagactagcatccagaatctacagcaaattcaaacaaattagcaagaagaaaaagaaacaatcccatcaaaaactgggctaaggacatgaacagacaactctcaaaagaagataaacaaatgatgaagaaacatatgaaaaactgctcaacatcactaatggtctgggaatgcaaatcaaaacaacaatacgatacgaccttactcctacaagaagggccataatcaaaaaatcaaaaaataatagatgttgacgtggatgtggtaaacaggaaacacttctacaccgctggtgggaatgtaaactagtacaaccactatggaaacagtgtggagattgcttaaagaactacaagtagaactaccatttgatgcagcaatcccactactgggtatccacccagaggaaaagagataattatatatatatatattatatatatcacagtttctttatgcacacattgattgatgggcatttgtgttggttccagaattttgtaattgtgaattgtggtgctataaacatgcatgtgcaagtatgtttttgacacttcacaattgtgaattgtgctgctataaacgtgtgtgcaagtatatatatatatatatataattgaatactactcagctataaaaagaaatgaattaatggcattcgcagcaacctagatgagattggagactattattctaagtgaagtaactcaggaatggaaaatcaaacatagtatgttctcacccataaatgggagctaagctatgagaacgcaaaggcataagattacacagtggactctggggactcagggggaagggatgtgaagaggatgagggaaaaaagactataaatcgggttcggtgtatactgctcgggtgataggtgcactaaaatctcacaaatcaccagtaaagaacttgctcatgtaaccaaataccacctgttcctcaaaaaacctatgaaaataaaaaaaatctaaagcctacggaaacacacacacacacacacacacacacacacacacacacacacacacaaagaaagggcccaggtccttgggaaaagcattcctgggttataaacctggcaggtggctgggagaagatttacatctcaaacgaccagataaataatttacaatgtaaaattatctaaactaaatgctctaagaaaagagaggtcaggagcttcaagtcaggaagaagcttgtctcaaatttagccaagcttaggggaatattaaggccttttgatcaaaaccactttatacttcttgtgacctcttcatcaagtgctgctggcttactttcatagaactagggtttgggagacatttacttttctgaattttagttttatttatttaatcatccactcattcattttcagaagacactttcaaattgggcaatgcttaacagagacttacaaaggtctctaattttctcaagctcctacttctgaatacattcaaaacttcagatgtaagtttattaaatggccttagcctaaaatccacttgggaaatggaatttgtttctttctttttaactaagaactctttaataagtctgatcccacaaagaattctctagcttgtttcttacaaaagagtagaaggaacatattactttatatagtaaaagaaagcattttggccccaaagatagcaactttattaacagcaaacaggtgtaggaaaaaataaaataaatgccctactactgatggcgttctctatatgtctgttgagaagaggacaactggaagagtgtgaatgacggggctttagttactgaaatttgattatggggcaaggttctggaaaaatcttgacttgtgctagtgtataataataataataatagagcaaacaaagatagaaactgtacttcattgaaggggctgtgaaatagaatttttaaagtgttcaaagaaaggctatttgcagaactttattgatgttgtcaagtaaaaagttagcagaaagagaagaaaatgagaaggaaagcaacttgtaagccactcatgaaacctgttgtattagtttctgtttctcctacactttctgtgctcctgtcccaagcattttctgtattctgagcccaatcctctcaatgaaaagcaaaaagagatatagattccaaagacactcatgccaataacaagactctaatgtcattgaacctgaagtttttctcttgacactagcatgaatatagttgacatttccttaataaagagcactgctttcttcgtaaaaatgtgtaagtggaatgccaatgtggtacattttttgactaaaatgaacaacaggaaattgggatttgagaatttataagaaaaggtgtggtaaatgtcacatccccagatcaccctgcatacgttctagtttacatgttctctttttgctgatgtctaatcataatggcatgacatagggtggttgagggggaatcctgtcatggtgactttgacatcccctgagccagcggagcattttgtggtggttgaacttttattaaattaattgctcaatgcaattcgcatggggtcacttggggtacagacaaggtctttattacataattcaaggtagtccttaataagaaatcttatttttgtactctttataattaagattctagatgcataagagaaaatttttgttgtagggaacactaagacaatgtactaaggctctttctgttctgtattaatctattttgaaacaacatatctttcctaagcatgataatttcactacaacctatggttataaatactcataagtattaataattcctatggttataaatgctcataactattaatatttccatagatcaatcaaaattcttttccaaagtcatcgtgatattatttagcaggatgaattcttttcccaaggttaatatttagacatgaaattttattccctcatatttatcaatcagttctagtgaggaaagggaaaaggcaaggctgggattatacatttttaaagatactctaaatatggccaataaagagttggttcttcctatgggtacacagaacaacaatatgataagaaaagttgaagaaactttttcatcttatatagagcatcccaagtgtttctggagaaaacaacacagtctgtcaaagcatatgtttgaagcttggttaaaaatgacatatacattctaatcctgggatgacaaattgatgaagaattttagatgtcactcagtctaagtcttatattaaaaaataaaatacttttattggtaattattgctaggaatgataattggcatatttaagattagaagattacaactcaaacctcctggctgtgattgcagcatattttccattacaccagactgcctgttgtgatttacattcaaaacaacttttcgaagcaaatgatggaagcttacagatgactgaagagattagtccctgttttatcaacttccctttcacttctctagcaaaattgagctggcatataggggctattcaataaatttccattattaaaatattagcataatttattattcacaaatgagcttctcctgtgagcacagagttactccagtctcgaactaatcataatggggcaggaggcttcagtactaacaaaaagcatggatcagaattataccctatgagctcctactttggttctaacatcctctgaaataattctctctgctttttattttaatattgtgtttaaactatttttaaagccttttattttcatggatgcttgtcttactaatacagtgcattaaacagttccttcctttctcctcaaatccctcaaatcaggattaacttgttgaattagaaatgcgtcacttcctctgtgacttgcaaagtatctgccccgattacatttggtaaacaaaatgaataaatcggcatttcagtggtgttcttgaatttaattcatcctggaactagcaaaataaataactgttttgtaatatattatatataacatatacccgcagatgaagagtgtttggcattaaggtataatacaacagaaacagtcacaggaaagattgatttaaagatgttgaagagagttcaattctaactaacaactgaaatcacaattttaaaaattcaacttaatgttccttttaacagagaatttaaaactgctttaattaggaacaaagctcggttaactaaaatgttaaatgtgtcaagtgctgtaagtttcaagtgaaaatagcacacaatttgaatttgcagatatcacagtaggctgcctgtgtcttttcagcttcttgaatgaaggaactcatcttaacccgagaggaacaaaccagaaaccagtttgttgttcaaatacattttggtatcaatttatgattggagacagtagagcatagtggttaagaaaatgtggcctctggaattagactacctgggtatgtctctgaaatctggaagttcaggtcttactacaaggtcagagattactcatctatagcaggtgttaactgtagatggctcatggaacaaatcctgctcactgcctgttcttgtagataaagatttattggtacacagtggacacctgctcatttatgtactatgtgtggctgcttttactctacaataacagaattcagtagtttcaacagagacattgacccacaaagcctaaaatattaattacttgcccctttacagaaagagtttgcctaattctgggtataacagtaattagacataggtttgcaagctgagtaaattcaatggttttgctgggaaggacttctgtagatttaatactaaaaatgtgcagaattatgttgaaaaaggttcataaaaagtagattatccaaaattctacttatttatattaaagctttattgaagcataatttatataccataacattcaccatggtaagcacatgatttaataatatactgtgccatccagttttagagtgttttcattacactggaaaactcctttgtacctgtttttagacaatctagtctcaaacaactactcatctccttttggtttctataaatttgactcttataaacatttcatgtaagtgcaatcatataacatatcaactattgcatctgccttctttcatttagaatattgttttttaggtccattcatgttgaaacattatcagtattttgttctctccaatattaaaatagtattttgttatatggatataccatattttatttattcaccagtcatggacatttgtattgtttctagtttggagcttttatgaataatgccactactgtgaacattcagtaacaagtctttatgtgaacaatatattttttcatttatttattttatacagattcttaaaaatgtgtgatctgctaaatttatgcgtatttttttcagaaattgccaaactgttttccaaagtgactgtatcacgttacattcccaggaacagcaaggtatgatggttccagtttttctgcttccccatcaacacttgttatttcctctttctgattttaatattctagtggatgtaaatgatatcttgttttcatttgcatttttaaacaacaaatgacgtttcatatgtttattaccactcacattgtttttggtgaaatgtctactcaaaatctttgccaactttaaaatttgatactttgtatttttaagttatagaatggttagagttccataaatgctagattcaaatattttatcagatatctaggtttatttttaacaactcatttcttcaggtcagacacagcccagagtagcaatatccttctgatttctgatagatggaacactgtgtagatgatgtgtagactttgaagtcagacagccctaggtccatattttattcctgctgttaccaccttgtagactctgactgagttgaatctcaaagtttaatttccttctctttaaaatggaattaataacacaaacatcgtgtgagaaattaataagcaagttcaagtcagcaacttacctcaaaatgaatagataaaacccaattcctcccctctaatacttatattatcttcggaagagaaagatgtttaaatagagaatgtcatcctgccaggttctatttttgaggtatttacaggatctagcagatattcaaaagaaggaaattgaacccatctaggtggggtgatcaggaagttcttggtggcataatatggatagtaggcattgttaaatactgagtggaatgagccaggaggaggagaaatgcaaagctaactctggtatgtgagtgtctttctttacattccctctgtgtttgattaccaaataaattttttatgtggaatttataagtgaattattttttagagagtgtttgttttctacccactgacaaagaagcggcattcatgtcaaggccgtcatggcaaatgagggctaaacttatgaagattggtcagttgcagtaagatttgtgaataatttgataataagattcagaatcgtttctgaaggatttgtaaataattgctagaagggttaggttgtaattatgcattaaaaagaaaccagagtaacccagtttccattattttctatttccttgcaatgatatagagctataaaaatggctggatttttttgtgcaatcagcagagaaagtaagaaagctaagaaacactggaaggcacgttaacttttttaggccaactcacaaccccctagtattattaatgaaactttagcacagcctagttgtgcatgtgttttgtgttaaattgataacaaaatgaaagtgtgataggcaaagcattaggggaaattctgggtgccatttgatatcctttttttaattcttattaggagcctgtcttcaaagtgtctttcagtttggcttaatgtgaaaaagaggagaatacttattttatataataatgtgacattatacgaaatgagaataaaaggatggagggagttcaaatctgggagaggctgagaagaggaagggtagcaaaaagccagatggaatgtggagagaagataaatcaggatatggaatgtatgcactcttcttttccaggtagtggtctttcagaaagtccagaagcagttcatatcctgacattacttcctctcaggagaattggaaacttatgtacaaaaacagtgttaccaggaagccacagacaatataaaatgtgtaggctcttccaagaagatttatcatcaattactatgaaatgcaaaaacaaacaatcacctgtaaggggaacgctggaaaaaactgtaaactgtcaagtgtggaattaaaaaaaaaaatccaggtaagtctcattcatgaacccttctctccctcttcagcagaaaataatagtatacatgaacagaagtagtgctatctacgggcaattttcagataagtcaaaattattagcatgatatgggaaagggatgggagagagaaagataatccaaaataaagcaaagaaaaaattttagttagtaatggaagctaaaacaaagaattggctgtgggaaaatatctgtgaaggtctatagggactgagatttcaactcccagtatagaataaagcacagctttgatggttatcagtttaatttgttcttgaattaaagtaggcttttctttcacttgtttccatggatccactgaactgggtagctgctagctagagtttcaatagggatatacagacacaacatttagattcaagtgaataggccatattatataaaaaacatatttggcagaaaaatctttatttgaaccataaagaatggatgagtttatgagataaatcaaagcaactatataataggtgatttgcatagacacagaagtcataacaaatggcctatgtttctttcaagatctagttcaaagaccttcccttgatctcctgatcaaaattaatcatccttcctcttcactctcactgttctctattgtaacaattatttcatgttccctttattattatatacatgctttatccttgaagacaagaactatgtctatcagagttttgtttgaccactatacacacacatgcatctttcccctagcatatggggtataatattgtgcaggtattggcagcatgaactctaatcacagagcaacacaaaattttgaacatggctcaccatgtaaatgttagattagattaactatacaaatctgagataacttacttagccttttaaattttgtttcttgttttgcgaatttggataattcctattgaaccagttgccacagggtgaattgagatatatttgtcccacctctttcagctgccatagaaagacaacttgaatcatcttacacaaggaagaaaaaaaaaaaaaaaagcagatggagaaggtggctttggctagggaaatgaaactgggaaagctctcagatcaaagaaaggattcaaggattccaggacactcctgggtttttaggtatattgtttcccccagagagatggggtctagctctgcagcccaagctgaagtatagtgacgcaatggtagctcaccacagcctcgaactcctgggcttaagcaatcctcctacctcagcctcccaagtaggtgagaatacaggtgcacacctccatgcttgcttatactttttatttttaatttagagacggagtcttgctatgtagtcgagtctggtcttgaacttctggcttcaagtgatcttccctcttcaaccttctaacgtgctgggattacaggtgtaagccaccactcccagctgagtcttcaggtatttctgaactcaactccagcagcaccattttcctgagctcctaatttccacattttaataaatgtcagctttatttcctcagtctttgtatatgtgaagggaggggctttcaaaacaacaaagaattcattctccctgtgaactctagcattacaaatgccaagaaaggacttcaggttgtctcactgaggccctgtgtccactcctggttataatcaggaacttactagaaagagggaagaaatggattcttagcggataaaaggcagtaactagaaagtgcaccccacaccagatgcttagcacaatgattacatatagtgaaagcttaatgagtggtgtcttttttaaaaataattttcatgaacaaccagtgaactctagataaacaatgattttactatctgcagtggcttatgcaatacgaatttgttacatgtatatctgcggacagggtgaaaaaataatgatctggattattatagtgcacatctttcctatatcagtaaattgcaatatccatcctaagcatacaagtttagcaattgattctctctagactgcataaagacccagtccacttctttccacttctgtggatacaaacccagactaaggcactgacatgcctcaatggattgctaggcttctaaataaattctctgctttcacttttttccttagtggctgatttcaccacagtaaccacagtgatcttttaaaagcatattcaactcttctgtttgaaatgagtgtctgctcattgcaataagaatttaatctaaatctctaactaggcttaaaattcttccgccatccagcctctgcctcccacggcaccctcatcccttactgctctatgtccctgtatgactagccttccttctgtgtttcaggaacccaacatactcccagctgaagatgttgacactgtttttcctttccagaatgttcttctttcagactgttatgaggctgcctcttttgtgatccttcttcagattgctaatgaaatgcgtcgccataaccaggagccttccctaatatttttggctaatgtaacacaccccgatctcatttcccattcccttcactagaatataaactcccagcaggtaagaattatagctctcttgtccactacattatccctaggcttaatatataggagggacttagtaattatatgatggtaatagaccaagggtgattaaagtagaaaaaagaaaagttgccagctcaaaactctcacattaatagatgttaaaacttggaattaagaaacagtctctgtagggctttgttagagagatgatttgacacactgtcattgagatgtgaggggtattgcagaccggataagtaagtggttacctgataaagtcctaagggaatggaacccaaattaaatatttttgaggaacaacagagaaataaacatcagatagatttaggaacctgctcagacttcttatcctgtgatttgtacaaccaggaaacagtataaagtaaaagaccactaggctccttagaaagaccacagtactaatatttaaggcaatcatggttcctaattttctggaaatgtagacattgaaatggcagaataacagcaggcttagtgttggaagaccagacagaggtagtcatgaccttgttgggtgaccttgaacaaatccctcttgtcactgacctccagttttcacctctgcaaaatgagggttggcttaacgacatgtagagcctttcctaccctaatatatatgagcctatagacttcctcacagaagcattcttcaaatataaaagaaaggtttacagagccttgggagtcttccttaaagtctatagggagtgaacaccaagaaaaagtatatcaattgccaggcagcttctcccaggtacaaactaggatggatgtggcagtaaccatcctgggactgtcctctttattttgtcagctcagtagaggataaacgaggaatgttaagatgaagtcatgggtgtgtgtgtgcttgtgtttttatgcttgtagattttgtgtcttttattatattggtttgaccttctttaaaaattaacaacaacaaaaggcagttttattttagggcttttaaaaaatattgttcatagtatctttgtcatagctcccaagaatctcaactacagctgaagctgcaaaatctttgtcttgttagctgcagatattactatcttaatgtgggttacagattctactacaagcctgaaaagaaccagagatccagcggaagaggttacatgcttaattcttaattcttgtatctgttatactttgagtgcaccaaagcagtgaaaattttccagagcaaactcagatatgccccagattttggaggacaggatctatccatcaagaatttcaggttagattccaatagccagtgactgagtctcacaagcaaaatgaggaattgcctctttgagagagaattccacagaagggaggcacctcgtgtgggatgaaatgaagcttgctattggaaacaggtcttcatgaagactagtcactacaaaagttttggtgatattagaaacagacactttaaaattccatctttatcagaaatgtttctgcttgctatttacaggatggaactgaactaggaaaagccaagggtaatggtcttatcctaatacaatttgcaaacctcactgttttcactgttctgtggccatttcaagacaggtttaaggaagtagatataaaataagtagtaagtatgattctctgtgcaacaggttagaagataaaaaatatatatatatttgctactaaagatttaaacagaggtcctcaattttttagcatttagacagcaattttttacagatatgtatgaaatgttcaaccctccatgtgagaggaaactggaatactttgccccaaaatctacttctttggcatatttcaagacggctattcaaaggggctacagacagtagaatagctctgaaaagctgtctttttgtgggagggattttcatctgtagaggaaatctacattagtgaagtaaagaacagatgcaaacaggctttctctgagactccccttatctgccttgtctagatctaggaaagattaactcacgggaaaaggagacctaatagtctgacacttttaaatgtctgagagagaaactttaactacagcctactgtttatcctttctcctggcagctcgaagattacctgagaggttttcatctgcataacaagacagcctttgcttggcatgccttcctcccctcactcttccagaacctgtgatgccacctccccctgggaaaccccaatctcctgttctttctgtagcctcaggatgatagaaacattttaaccacctggctccacctctgagcctcatacatagcacatggcttctgtgctgacgcacatgataaaatctgtattttttatacatttttttcttttaatctatctattgtcaattcatctcaatagacttagacctgaaccttcaaagagaaagtttgaacttttctaaacatgaaaataataaataggaacacacacacacacacacacacacacacacacacaccccttattatctggacagaggaaaataataccaaaagaaatctcctgctaaagagaatgcaaggagggttaaaagatcgttattgcatattataaatataaaaatgttgtagaatcccaaaatccagttttgcatacccaatgcatagtaagccaaacactgacacatcagcacttaggagcagagacgtatttgatttttccaaagcaagaaagtcggagagacaaatatcacaaattcaacctgcctttgaacataactgggagcttagcttttatgagtaaggtaggtatgcgggaggtgagatccccagatgatcaaagatgttttcttccctcagcctgatcaaactcctggatgccatcaaggaggtctgcatgacctaaggatcatttttctttaaaagaaaaacaagttcattaatcttgcgggcagccctccggggttagtgtatgaagttaatcaattactagtgactcccctctatagaaatgactatgagcaataagcgtgtgtggagggggaaaaggaaaaagagaaaggaaggtaaataaaacaaacaccttaaaatttttataacgcaggcttggttacaaaaagagaagaaattcattctgattccaataatctagaaatgtggaaaggttcgatttgagtaaggatatcacttaggagtaaacctttcctgaatgagcactgggttgtgagtatatgcaaaaggctagaaacagcaggtactatttgaagagaagtaggcaatctcatgtgacagaggtataggtaagtgaaaacgtgattgagaatatagcttgttgtggccaacactggggttatgaatttaacctcataagaatataaacccctcccagcactttgggaggccgaggcaggtggatcacctgaggtcaggagttcgagaccagcctggccaacatggagaaaccctgtctctactaaaaaaatacaaaaattagacaggtgtggtggcacatgcctgtaattccagatactcaggaggctgaggtgagagaatctcttgaacctgggaggcagaggttgtggtgatccgagatcatgccattgcactccagcctgggcaacaagagtgaaactctgtctcaaaacacaaaacaaaacaaacaaacaaaaaagaacacaaaccctttgttatagtatcaagtatggtaccattcaccaactcaaggatgagtatcaaggatgagttcaaatcctatacctttaataaagcctttctaattattgtagctcacaatgatatctctctactatgacaatctttattagctaatacagattttccccttaattacaatccattttgtctcaatttctacctgcttcatttgtgttcatcatgtttctcacaagaaacttagaactctttgatgactaattttatagtataaaatggtcagacacagttttaggtactaagcactaaataaacacattactgactactataaagtgaggaggaaaatcataatccaaaatcaaaacaattacagtcacaacctcatgtgctttgcttaattcgcaggacagatatggatcctgtccagcgacaagaagggaacttgcataaagggtttactttatgtacacttcagtcatattcaccctgctgtgtggtcaaaaattcatattatcagagtgccaacaatgcatcaaatgtgctgttaatttcactcacagcagaggttctgcactttgatgagaaccacttaaatttaatagagaagcaagctgccctatgcctggtctcaaactggaaagtgacccaaaagccaggagacagatttatgtgacatgcacagaaggtgatatgtgcctcttggcccacagagcagatttttggccagagcttgatgagtagatacggcagtctggagacagaacctccgttgtgctgtgcacgagtaggcaggcttgtttctttcatgcatggcccagaaaaaggacaaccctcattttagagagctgataaaagtgtaaaaaaaaaaatttatccaatagagcagctctatgcagacaccaaggcaaccagcagtcctggagggagggtgcagcctgccaagacgattgtcagaaatggttgccagagtcagatgctatggatgtaggaatactgtctgtagcttggagtttggaacctacattaagttcaaagacgagcggcaatgactgattcaattcccaggggaacacccaagctatgttatctataatttatttgactttaaaggcaatctttgatttcgaggacatacacaaggaatgatgtttcctctgtaagagaatctgccttagagcgtgtgtgctctggatctctctaaagatgagcatgaagattgaaatgacagagggtgctcatcatgaactgtcttgattaggtaaattctgattatatttgagtcaagccatgggagtataagcataactctaaagcaacaagcctaattggttcaacagagttatgaaaactggagcagaattgtcaatcgccgtacctaactaacggaacaatagagccaccctacaaatagttgggaaatttagaaagtaatctgtcaaagtctgcacagcagttgttgaaatgcttgtccccaaattgtaaccagagtgaggatgggttaggtaagtgatgatggctggaacttttgtctcagatcaaaacttaagactatactcacctagctaatatcctccagtagtgtattaggctgttttaaggacaatcagattattgatgtaaatgcaactgaaagggatgtaatctttattcatgtcttgcaaagtacatattctctctctctgtgtgtgtgtgtgtgtgtgtgtgtttagggagtgtaattattaaagtaaacaatatagcaacaaaatcatcccaagttttagcatatatacacaacatatcagtgttagatatatagcaattgcatagtctaataattacccaataggatacctttactctaggagatgaagtttgaataattacatgcacagcttatgtctggccacaacttcagttgctataatcagaagtatccttaaaagaatgaggtcatacacaaatgtaatcaacacctgctatactatgcttttatgacccaagcatgtcgggacgtacatcaaaccttagatcattaatgtgttttagcagtgattagttagcagcaagaattaggcacatttatagctaccaattattcagcgagctactgtgctatcatagtagagtgtttttagtctactcaaaaattacaaagtttcatttgttattttatgtagaaagaaattgatacctagagaagttaaataattagcctagtaaaatgctattgataaacagtgttcctgggtgttacataatgctctaggtgatattaaggattcatcttttttgttcctctttattctctgattcatatctatgtttctttgattcacgtctatgtttcctagtgacatgggaagtgggatggagtttttaggacgaaggaaatgcatactgatggagaatgtgacaaaggtaccaaagattgcatacatctatgttaagattctgtctaataatgtaaatgaatgacttacacaagtatatgttttatagtttgtgataggttttatatatatttccttacacagtgacactgtgaattgctgtagtttacattttgcagatgttgaaattgcagagctcagaaaggttatgtggcttgcctaaggtcaaacaatgtagtatatagcagagctgggtcttaagcccagattttctgagtcaaaatctagttctttccattacagcattcttataaatcctcagaacatagctgttcctccaatgtgggtcttggatatatggtatcaaatcacttcagatgataaatttagtttgttgcaaaaccattactaaggtaagtgtaaatatcttatcaatcatcttattgtttgttgttactttttggcataagtgaaattggatctataggcatttggattcagactgtcgataacttccttcagaagacattgtaattgattctttcctgcatcttgttatcaatgttaataatatatgctactccaacataatgtaccagtttactgagttcagtgggatattcctgcatcatcaaacttcaaaattggagtattgctatgagaagcattcatgctatattgttagcaagtataatattttataaagttcttgcttatatatttatagaaactgagagttctaaccaaattatgactgacacaccttttactgtatcggacccagttgtcttcttttctgaggcaaaacacatgtaaggagaatttggatgcagcagcattgaagaataaggtgtttttgtactatgcattaatgcagacagcgtgtagggttgaattccattatgaatgcaactatttatatccaatatccattatcattaatggacagattttcttgtgactccagtgtggaatccataaaagatacaaatttaatagcaaacaaagtcatcatgttcaaccatgaaacagctgagaaagaaggggctgagggttgcattttctattccaagatacctgtctttaggattctaaaatacagatagtatatgcctatcagaatgcatgtgtgtacactccaaattctgtcttattgctcaatctggtttgttctatgatttggaatatgtcactttacctttctttagtgtcattttatcccttcatagtgcttacaattttcaaaaacacacttctgacttaaatgaaatatatagtcaaagataaacaatataacaaatatttccagtgctgagtcttttttataatgtagaaatgtaacaacttgattcctgcgtttgaaaaagtttaaaagaaaatgacattttctcaattgcaatattgctcaaaatagaaagatggacagaactcttgtggtgattttcgttccaactaaccatccagctagggaaggagtcagatattatgcaaaaaaggaggaaagacacttattttgatcactgatttctactttgaacagttagtatttttagtcatgcaagatttatcgggaaatctaaaagttcttaaaaagatgataccactatgtataatcaaaatattgttgtgaaataaaaatctattttcttcttttttaaaaaccttgaaaagttaaaaaaaatcgtattaattgaaagagaacaacaatctacagtgaaagccattgtggagctactttaacgatacacaatctgtgagctatctgaagactgtaaacacactaatatttcaagaagtataggatgaatcacccatttagaaacattgaagagaagatgaagaagctcggagtgagttgtgaagcaatgaataaggatgtattacacaccagaaagccatcaatatttgtttattatgtcagggtaaggaataaatctgtgagctaatttgtattcttcacagttaattccagtgttcctgcttgagcatttttgtttcagaatgagtgctgcacagctgtttaatggtgccatcaagaattcggaaagtcatggtcccttggagatagaaaggcattgtaaagtatgatatcaaaccacaaataatgaagcaccattaccttacaacatcgtatacttctcctttgcgttttctttctcttctctctccctgcctcactctcttcctcttaagataattggatttgttaacattcccttcatttaaaaaaaatacatctactcagaagacgagcaaaacaaccatgagtttaaatgatcaaaagatttcttttgttgcaactgcaagctttttggaaaagattttttttaacttagtttgctttagtaatgactttgtcaataaaattaaacacagaaattaaacaatttcatatgtagaaagacctacgcttacacattgctcttaggtaagtcactatatatattatagcttaggtttatacatgtacctatgttaaagtagacgttttttaaaaattatttatttcacttagatactaattgctatccatcttttgtgttctgtaatgccacatgctttgccttcttttctgattttgctaccctacagacaagatttacacttgctgccttaccttactttaaaggaaaattgaaatccttaactctgcctgaaattacgagacgaaagtgacaaaactggacttgtgctctcaaactctcattaaatgaggttgaagtttgctcagtccagtgtcacagaaagttccagatgagaattctattctagtgattacagtcctgtacatgtatttattgtagatgtaaaggctgagatacctacagccttgtttttgtgattgctttccttgctggtaaactaaagaataaattagtgtccgtctaccagtagtttcaaagtcttagaaaactgaagaacaaataatctaagaaatatttgatgtcctctcctactaaaaaaaaaaaaaatccctcttaaccaaatcaactataagcaatttcaaaatcacatgactatattgctaggccagtcatcaagagcttgtcttgtcttcaaatatgaaattctatgtatgatactcacatttttctcctaccaaatatttttaatgacaatttctttcactctgattgcttttatgttcttagtgttatattaacatcaataaatattaaatggcctactcttgtaagaaaaaaatatatgtttttctcaagttgtattttaatccacatataaggatatgccttttcaaatatgtatacagtatatataatatgagtgagtccacatatatttgtacttataaaatatcaaacactggttattaataaaaaatttaaccaattacattgatatttgttcgcttaatctgaaacttctgtccatttgacaagatccagatgatgcaatgaatatatttttaaatttttgcaggtatatacatgactagtgcaactggtagaataaagaaaatgtaagcacatataataatttctattatctgggtgctaaatattgctatttaaagatattgatgaaagggtcatatttttcagggtatatatttttccccagtagtaatatattaaaactatgtaaatcaactctttgttgtcttttttgttttgaggggaggtggcaaaaggaacacttttataaatgctcagttaaaaacagagcacattctatttcataagtctctaaattgttccaacaatgaaataaaaatctcaatttttatttgtttgttcactaaagaattataaagtcttcagaggagaactgatttcagaatcatggctatgaatgtaaagaaggtcataaaggctttgtgttgactctcacttctggttttccattaatcatctggttctataacatctagtttgcaatactatgaagttaatccctgattcactttgaagggctaaagttatgtcttagaaaatcgcacatctgaggcaaatgatgacatgtataattaaatgagaaataacatacttcgtaggaaatattacatgttgtaaacttgtttcgtacacaaaggatttaaagaacttcctttttcccaaaaacattaattttagaactttacattctaaccacacatgcttaaagagaggttttatactgtccttggtcctgagcaaaaccctagtatattctgtcaaccaactgtacatactaggtagcttacggatcagtagtctaatttttctcattcaatagcattagagttgacatgcttgtgcagtttggtttatgtctgccttcctacagctactcagacatggtttttttccttcaaagcttcagttatgtattgaccataaagcgtaccaagcctcagagaataggaagagtccaatgtgttataaaggcacagcgcttacatgtatgtagtaacatctctaccaggaagccagtgtctgagagtcaacataattctttctcctattaactctggcacctgcttgagatccagaaaatagaaagattgttgttcttttgtagctttttagagaaggggtctgcagttcttgtagttctaagtttcccagtgcaactcaacaatttgtactgacttagcttgaaagtcaaacaaaaaggaaagcatgcaaaacctttcagttatatcgagagaggtagagacagccccatagttgattcctgttcaggatacgttgtgaaggccaacatggtgtttatgaagtgacagagatggagaattattggaaacagtagcaaactacaagtgaaaaaccttgtacaattattcttaacatattatttatattcagatgcaattctacgaatgataaatagatgcttttacttagtataagttgacttccatctgtgtttcttaacaaaagaataatgaaaaatttgcagggagctttactgcaaattcaattaacatttatattactatgtcactcttgataatttaaattagataattgtattattaatcattgaatacctactctgttctagacactatgctaggaactggagaaacaatgctatttgttgaatatgtccactaaagttgatgtgttggaaagctaatcctcaatgcaatattgttgagagatgagtcctaataagaggtgattaggacatgagtattctgtctcataaatggatttatgttcttattgcagaggtgcttagttattgtgagagtgagttttgttataaaagcaagtttgggccccttttgctctctctctcttgccatgaggagccttctgacatgttatgatgccacaagaagtccctctccagatggcgtcagatgctgacaccttggaggttggactttcaaacctccagaactgtgagaaataacttaattttctttataaattaaccgttcttaggtattctgttatagtagcacaaaacagactaagacagaaaattgatactgaaaagtgggattgttactacaacaaattcctgaaaatgtggaagtggctgtggaactgggtaaacaatggtagaggctggaagaatctgaaggagtggactatgaaaagcccagtttgccatgaatggaatgttaaaggcagtgctggtgagagctcagaagacaaaaaatgtacagaaagtttggaacttcttagcgattacttaagtggtcatgatcagaatgttggtagaaatatggttggtaatggtttcatgaggtcttagatggtagcaaggaacaatgtactggaaattgaaatagaggccatccttgttagaaagtggcaaagaacttggctaaaatacttccatgatctagggatttacggatggcagaattcaagggcaatgaactaggatatataaaagaagaagtatctaagcagcaaagcactcaaggtgcttcatagcttcttttggctacttacagtaaatttacagaaaagaagaaaagatttaatgatggaattcataattaaaagagaagcacaatggaaaaatttggaaaactttcagcctggctatgtaaagtaaaaaaaaaaaaaaaaagaacatgtttgggagagaagtctaagggcatgggcgagcaacccttggctatggacagaatggagctaggttctatttatcaagacaatgtgacaatgaccctgaaggcatttcagacatctccaagccaagccagcatcttgagtgcaaggtttccagagaagcactcgcaagactttagtatttgctgcccaagtctacctaaggacttggctcccaggatttgggtgcagtgtttctcaccagccacagctcaagcagacccaggtgaggcttatgacacagttccaggaggtggaagtggtaagccttggtggtgttgttatggtgctaaagagaataaacttgttacaaaaactagattggcctcttctttttccctgttgtcatgaagggcctgctgccatgttatgatgcaggaagaaggccctcgtcagaggcctgtgtcttgatattggacttcccagcctccagaactgtgagaaataaatttctcttctttttaaatcacccaatctcaggtattttgtcacaacaacacaaaactagatacttaacaattgttgaacttgtgatccagctaaagatgtaagatcaaatgtgattccaagttttgtgataaatgaaaggaaaacacaagtggtgttcacatttttattatgaaaacattcaaatgaatataaacatagagagaagagcatattgaactcctagatgttcctataatctaacttcaacagttatcaatggatggcagattctcacgtgcattctttttcaaaccttaatttcccccttactccctaaataaaatactagatacaatagcatttcatccactaaaaatatgtttgtctacaagtccctttttaaaaagcacagtgcctattaaactatcatgcttgagaaagataatagcattatttacttaatatcagctaataacatatcagtgttcatatttccctgattgcctaaaacattttagtttactcatttttgttaagttatccaaatcaggtcaaaataaactcttcatatgacatttaattgattgataggcttttcttatcactttatatgaaaattttaaacctacaaagacaaaaaaaccatacaaattacaccaaacccatatttaccaactaggttaaatcatatattattatacttgttctaccacacatctattcgcctatctattcctccactcaagcactaatctatcttaatttttgaaggtttccaaaactatgtgactggaatttaagacgtgagaagagtaattaaagatgggtgcagctggagtagactgaggccaaatcatgaaaagcctgattttggggggttaagaagtcagactttaccttatgttattgtgtggaagacagaaaacaaactagataaacaagtaagaaaggtatgttgtatagtggacaaggagaaatgttaaaaagagaattggaagcaagaacagttggaaggtagcaagatttgcaattttaagtgagtggctagtgtacatcccactaagaagatgacatttgaataaagacttgaagagaagtgagtgagcaagcaagccatggggatatccagggaatgaagattccaagagagggaaggaaatagtgagtgcaggccccaaagctatgataaattgacattttaaaaatcattttaatgaagcataattatacaaacattataatgattttataagagtaataatgtaacaatagaataaaaagtcacccataattctgctactgctggaaaacaaattattttcatgttcaattttttagacttttatttttctctgcatccatgtttacctaaaattatgcttatgaaaaaaattatttacacatacatgcatatagttaattttggatgttaatatttttatttctttatttctttttttttttcttttgagacagagtcttgctctttcacccaggctggagtacagtggcattagctctgcacactgcaacctctgcctcccaggttgaagtgattttcctgtcagcctccctagtagctgggaccacaggtatgcaccaatacactgtgcgtgtgtgtttgtgtgtgtgtgtgtgtgtgtgtgtgtgtgtgtgtgtatagtttttgtagagacgaggttttgccacattagccaggttggtttcaaactcctgaccccgtgatccacccgcctcggcctcccaaagtgctggaattacaggtgtgagccacagctcccagcctggacattaattttgtataaatgttttctgtgtattatatagcctacctattattttaatgcatgtctatttcttatttatgtatttatttattttttgagacggagtctggctctgtcgcccaggctggagggcggtggcgccatctctgctcaccgcaagctccgccccccgggttcccgccattctcctgcctcagcctcccgagtagctgggactacaggcgccgccaccatgcccggctgattttttgtatttttagtagagacggggtttcaccgtgttagccaggatggtctcgatctcctgacctcgtgatccacccgcctcggcctcccaaagtgctgggattacaggcgtgagccaccgcgcccggccgcatgtctactttttcaacaaataaaacaccatgaaatcttttacttagcaatcctcctgttgttaaatatttaagtagtgcatctttatttttcttaaaaactatagcaataaatgtatttgtagttaatttcgtgtttttttttttttctcggagtctcgctctgtcgccaggctggagtgcagtggcgtgatctgggctcaccgcaagctccacttcccaagttcaagtgattctcctgcttcagcctcccgagtagctgggactacaggtgtgcaccaccacgcccagctaatttttgtgtttttagtagagatggggtttcaccgtgttggtcagatggtcttgatcttttgaccttgtgatccgcccgcctcggcctcccaaagtgctgggattacaggtgtgagccaccgtgcctggtcgttacttacttttcttaaaaaaaataaattttattgtaactacctattgggtacaatgtacactactagggtgacaggtgcactaaaatctcagacttcaccactatataattcatccatgtaaccaaaaaccacttgtactccaaaacctattgaatttttttaatttaataaattttattatgtatatttaaggtatgcaacatgatgttatggaatacatgtagataataaaatggttattacagtaaagcaaattaacatatccataatcttacatagttatctatttttttatttttgtggcaagggcagctaaactctactcatgtagctagagtccctttcaaatctttatttaagaaaaaattcaaaaatgaaattatggtatcaaagggtgaacatttcaatgattttgcattcccaaagggttacattaaattgtacttcaaactaacagtatgtggttttgccaacttcacaaataggagtaattaagaattagaggatgtattttgatcacttaaattataaaatggaattgtatagcgttattttgcattttttattattagcaaatattaatattgtgccatgtgtttctttgatagttagatctgttaatatgccgattgcaggctttaggtttttttcgtaattttttaaattttaagcattctacaaatgttatctctcaggtcctaggtcttaggtttttctcatagtttgactttatattttaagcattctacaaatgttgtttctcaggaaaacttacagcccactgttcttttgaaaatacatgcaaatctctgtaatatacacatgaaattttaaacaattactattaagttattcaaacgtttcaatttttctgattataaaataaatgcttttttagttttttttttttaactttctacttgaaaactaaaaggcaataaaataaaaaaaatcagttctatttctgtgtgagaggtaaatgggacagccagacttatctcccctcttttccagtgccttatctccttcgtctctttaatcaaataaaagtgcatatgcagactggacagtggtgttagaggacaataatatttttactaatatataggaaacaggaagaatagtattctgttagtagataaaacagagcagagggcatccctccacagcaggctaggaatgtactgcagtgaaaatgggggccgttgcctacgtggcaaaacactgaaagttcccaagataaaaatcagtgactattgagcaaagtgagttctggagcagtatttagggaattgcattaaatggctctcaccggaagagctgcatctgctcatcttgttttatgtttcctcaaggcatggacacaacatctatttatttattttccaccactcttccccacaatgcaaactcgatcagaacagggacatcctccattctgttccagtgcctaagacagtgtctggcccacaagaggtcctcaagatgtgctgcgtcaatgatcccaatccaaaaatcttccccacatctttcaaatggtcaaagtccctctgctcctggatctgtatttcaatgtactactcttcgtgtttccaattaaattccataggccctgggttctttctggtaattctttctacggagactgtcatacctctatttccatgatgtttccttgtttatcttttccagattcatcaaaggcatttagtaggtcatacaaggaggttcatcaagactgtcagccaagtgtaatttttatccaaacatgttatgttttaataatttaaaattgtattcttggcctctctggctacattagaatgtgtcatatttaattgcttacgccttttgcttcagtagaatggggcctggaggacctctgtaaaattcttcagttacaaacattttcccaactactttaatgggatgtacctttctggcctcgtgcacttttttgttgttgtttttaaacgcaacaaagtgtcagtttcgcttctggccacactataaccattccccaacactgatctaacttcaaaagcatgaaaaagtgtgctgtgcttttgaagttgggcagagaatgcacataaacatatcctaagagagtaccatttcaaaaaagccatttcctattaagcagtttcaaattttcttttatttctcttttcattaaaaaaaaaattagtcaatgttctctttcagttttgcttctacctagtttatcatattggtgaacttttgatcttaaagttttgtttttctacatttattccaacgttttgttttataccacattgccaaagcatttctgctgctgtattcctaagagtggttctaaatgagaagctctcaataatgtttgtttaactgttcaatcttcatttagactctggatagcagccctactggaggcctggtatagagcaagagggaatcatgcatctgatttaagatttttaataaaaagtgaatgttaaaagtaatttgccaacaagggaaaatggcaaagaaaagagcaacccagtgaaattcctgttatggtgaatacagaattatgagagtgaacaggcataaagggagtggtgtatctcacactacattaaatctgctagggacagacactcaaaagaggttcagagaatatagtacatggaatcttcatagcagaaactgaggttgtgatatgaaatcattccaatactgtgataaatggaaagagccaactagacaattgaagctcaacatcttttataaataattgtttagtttggattttagtcaatgaatattaaacatcttctgtctgaattatttttcttctacatactttacctcagatcattctaacaataatactggaatgtatgtagtatttcccttttacataagagaaattgaagctcagaaattttaaataacttgcaaacattatacagttagtaattgttcaagttggagttttattaccagatggtctgattctaaatgcagtgttcttttcataacatacaactttctctgttggacctacagtggccaaagtaaacgaaaaatagccagatagccattgtgtgctttatagaaatactcgtgcagatcagaatcacgattagcagtggtcatgaagcagataaggaaagtcaacaaaatattttctgacttcagaaaggaaaagtatgtctcaaaacagaatttataaatgccacatatattcttatctcgccagttctgttcagctatttctgatttaaacatttttcccatctttctggtttcagatgagacattgaacaaagtcaaattaaatgagagcgagtttcttttattgtaacaagattatgtacatatacatatgaatgcagctatgagcacagactttttaaagaattttgatattcaaatccttctctttcaaatatttcattcaaaccagaataaggaaatataccagaaaacaataggagagaaaaataccattctatttgtaagttacatgtaattactctcttgttttgctaagtcatctctagtctgagaaatgattactcttattaagcatgtggatggaatatattgatgaatatataaaacacaaataatggaaatatgtatttctttaattttttatatgagatactttaagagttaaaattttattttacaaatacatctgtatttagatcaggccaatacaaggaggtataaatattttctttactaaactatttgatgtttatcctataatctcatcatattgcttttttctttctctctctctccctccctcccttgttcttatttttgaaagggccactatgagccaaagagagaagaaaatatttgttttgtgccttgcataatttttcatgcactttttgggttatattgttgtattgctctcaccaagaggaagcaaagacctccttttcctgctgtaaaaatttcatacattcaaaatgaattgtatctaaaagttctctcttcctaatcaagtatacttctccttcactgttttaacgaaatagttttttatctgtagtcattaaatccagtgtatactgaaaaatgcattcttgaatctgatccttgctcttgtagaatctctctcttttgagcagctacttatactctaaatgattatcttcatgatgattgaattttacaatagattacgaataactactggcatatgttctttttcatatttgaggatgacaaccatcattggattcattagtagaatgcatactgtgtagaaaggaaatgtaagaggaaaggagtacacaaatgctagcgtcaagactggtgtcaagactatttgggtttcatatttctgtcacttactagctgtaggaaaaccagtgaagctctctgtgtcttaatttcatcaactgtgaaatatacccaccttggatcaatttatggaataaatgacttaatttgacataaaagtgttctataaatattaactatttaattataataatgctaatacaattattgtcttattaatatttgttttattggattttttattgatatactgattttcctatgagttgtgcagcctccactattatcctacattttactaaattcataaaatctgacagcagcttgctagtgttaatcatattatctgttgcccctgggatcttatgagacaatggccttgacctcattaaaatgaggtcataaaacgagataggtccaagtcagttggtgactgctcttactggagtaattatactatatgattcttagctcgtctttggtctaaaaggataacaatggtacttgtttgtacagcaccaacacagcattatcctgcaactcgaatttaaagctatcaattgataataattattccttgaaacagtaaaatgtttaatttcatttacatttcattagcgtcattatcactcatatcactaatagtgcaaaactttacttttttggtaacttgaaaaagtaatatttttaggcatggaaaattgaaggaattacattaattctttaaattaattaatttctctagagatatcttcctttgatgctcaaagaaaatgagcaatcatttgtttccagtgtgtgttgtttactggacccctttctgttagtgtttttaataattgggagtaaaggatagtctaattcactgtatattactgaagaaatctcctatatatccaactgtgaactgttgataagtcatgatattggcataaagaagtaggtaagactgcacatgtgtgatttatacatgtatttctgtgttttctcctgccatctgtacagtggcagagaagctgaaccacatacctcagtttatttaatgaccatatttaactcccacagtgttcccagcatgcaataaaattatattaatgattacaaggaaaacattaataaagaagtaaatcagagagcttgtgggttcagccaaaatgaacttcctagttcatgctggcccatgtgaatagggatctgattcaggttaagttttcattaccttatttctccatttggaaggctgtatgaatactaatgaaagcaaagtggtctcaagatgggtaaacatgcagaacctaatagtatgaggttttcagtagttccacatggaattataataatacaataaacacagtggtgaggtattaataataaatatgtaaatgatttactcttaaaaatagctgttcttcaaaggtgagaagcccttatttaattatttgtgctgagtagcttggagaaatgctgatttcagtgcttatgtgttccttgggaatgaggcaggcaggttaaaatgaaaacaagccaaataatcaaacagcacaagtatgtgggttgttgaagtttttttgtttgcctgcatgctgatttacatgcctgagcaaaatggaaaaaatagagcgttcaggcctattagaacagagccttccttttgcaaatagaccatgattagaatacatagtgatatgatgttggatatagattctctgaaatgaaattaagtctctttgggcccattcttactgctgaattttatgggaggaagtggattctctagtgggactgttaaggcctgcattctaaggaaataaatgcatatttaatgagttgcaaccacatgtgaagcctcatgctaggcactgtggaaataaaaaataaaagatgtagtactgatgctgaaggcattggaccaattagagatataaactcataacatgaagtgctagaaataatagagtcgttgaaattggatttgaatttgaatccgggatcacctgtcagttcaatgacgtgcgcaatttactaaaaaaacactttgagtttcactttcatatctctataagaggactaatgaaacctaacttgcaggcttaaaatgattataaacaattatttgcaagaagccatgagccagaaaatacactgtgcatttttcacacaacctgtgaattgctccaaattgccactatattgtaatataactgacctctcaaaaaatttcagtaaaaagctaaactgctatgatgaaaacatcctaaagtacagtggctccaacaagataaaagtttttctctaacatcaccatctagggcaggtaggcagactctgatccaggaagtcatctagtgatctcagtgagtgggtctgcttttgttctagctgcacttaatttcagccatatacaaggaaagagataaatatcaggatggtgcaaaagtaactgtggtctttgccattacttttaataagtttaaggtacatgtttttaaagaaaacaagctataggttggctgcattcattttgtcacatttcattagtgaggatttactcacgtggtgaaaactagggatatgagagcctgcaaagtgtgctgtataatcatatgcccaggaatttaaaaaaattgatttggagagagcatttgtttgccacatttgttcgcagttacatagcaataatgtagttaaattttgaaagtttatttctgctggtagttgaatcccaaattcatatctccagattatatttatcttctaaggtccgtagcaataaatccctctcccttacttaaatcatcttcttgcaggtctcagagccattgcatacttaacaagtatacatcttatctcttgatctactttgtaaatctggttccttttcagtggtttcctacaccaatggagcatttagttaggcaaaccagacacagcagcattgcctttatcagtctctactccctcatctcccaaagccagttgaaaaacaagccctgaagcctttgccttctaaacacagcacaactctagctacctccctgtcttcccacggatccactctaaaccatggcactatcctctcttacctgatctaaggtactagcttcccaaatcttttactcacgtccacctttgtgacttgtctaatctccacatcacagccagagatgatgttgtggatggagttttgttctgttttgttttacattctaaaaatctgatattatgcccctacttaaaatttctcaatgactttcacatgcatgttcttagttgaagacaagtacaaaatgcttcaatgtcacctacaaacccctcgatgttctgggcctaacaatgttctggcacctcctcctacatatgctgactcatctcatattttactttgacttcttccatatggaccgcttgttgatttcccctaagtcccgctccatctcccagcacaaggtcttttcatacatggttttctctgcacatgttgttctttccccccattttcactgaactctctcctgtttaccaaatagatttcagctcaatagttaatatctaaagaaaggtttcctctaggctttttgatatcattatattttcttatatagattccaggtacaataaacatgttattctaataacacaatagcaatattgcattgatttctttgattatttgtttagttgtctctctacctaccagactgaggtctatgcatatacactgacatatttttttcactgtagattactaaagcttaatatgtctagatggttcataataaacattctataggtatttttagaagaactatattaaaatattttatttcaaaatgaaaatatgtctcatttgtttcaaacgagtagtaaaaaatagtgaacatcataaaaattcagaagataaagaaataatatcaaattgaaaggataaagactggcatcaccaataatgcaatttttaaggtatgtaatgaatgagaaaaagctttttgaaagacaagaagaatatatacagaattcggataacaagaaaggcaagagccaatatggaaagtttctatattactggtgctcaaggtgacagtggctagaccagattgattaaaagggagcatttttgtaggaaaattatgaacatgaaaagttgagaatcaaattacatctatgttagtaaggaaaatctagaagatggatttagtgaatgcaaaaacttagttcacttagggatccagagaagaaagttaaggggaagtatagatgaagaaggaagaatatgagatgagaagatactggggctgtttactgagacattttgtgtcaatttaggtgataagggtagaaacagagaaaaaagcagctgaaaaagaatcatttttaaaaatgactttcttttcagaatgacatcaaatcaaaggtgtctacaacactattaaaatgtggaagttgagcccaggaaataggccaggcatagattatgagtcatcatcataaagaactcaaatgaaagaaataaaaaggacctttaaaaaagaaaacagagaatgagacagcaggaggcttaaactgaacggttgaaaagttctatatcaaggatatcagagaaagcataagacatagcaaagttatataagagctgtattaagagtatggtaaagttggtgaggtacttatgagatctcccttcaaggaagtgcagtgtagacatctttcagctgtcagctccttcaagatttgtctctgctgcagaaagctggtccaaccaaggtcacactattccaagagcagcctgaacacagtgactgagaaaggcagaagtataagcatctgacatctcagtcagatacaagccaattctgatggccaatactctttccagagtctcttgcacccacacctggttggccaatgctatgtcagacattcattacagttggacttctgcccagtcctgcttcctccttcttcctgtcataggtattgatccattaaaaaacaaaacgaacaaacaaacaaaaactttgcatcccaaagcccacctcagcatgggcttactcagagacccaactgtgataagagctgggagaaagagcatacgagcttcaaggatgtatttcataataatcatttaggtataaatagaacattaccagtctcagataacatttacatgagttctttttgatacctcatgtccctttttcaaagttgttgagtcatttcaggaaattgagtcttagggatttaatttcttccatgaattgattctgcttgttggatgtgtgaatctggaactcagaagaggagtgatcaggaatcatccagttactcttcctgaaagctataccacttttgtggcagaaccagggccacaaataagaacttctgtctctaagcagaagttcttttcatttcatcctgttgtgggaagtcagggacactgaacagagggaccaactggagccacggcagaggaacatcaattgtgaagatttcatggacatttatcagttcccaaataatactcttataatttcttacacctgtcttactttattgtcttaatcctgttatctttgtaggctgaggatgtacatcacctcaggatcactattgtgttaactgtacaaattgattgtaaaacatgtgtgtttgaacaatatgaaatcagtgcaccttgaaaaagaacagaataacagctattttcagggaacaagggaagacaaccataaggtctgactgcctgtggggttgggcaaaatagagccatatttttcttcttgcagagagcctataaatggacgagcaagtagggaagatatcgctaaattcttttcctagcaaggaatattaataattaataccctgggtaaagaatgcattcctggggagaggtctataaacggccgctctgggagcgtctgtcttatgcggctgagacaaggactgaaatatgccttggtcttctgcagtacctccaggtttactagggtggggaaaaaccccaccctggaaaatttgaggtcagaccagttctctgatctcaagccctgttttctgttgtttaagatgtttatcaagacaatacgtgcaccgctgaacataaactcttatcagtaattctgcttttgccctttgcatgtgatctttattctcctttttgccctttgaagcatgtgatctttgtgacctactccctgttgttgcaccccctccccttttgaaatccttaataaaacttgctggcttttaaggctcaggtgggcatcacgggtcctactgatacgcgatgtcactctcagtggcccagctgtaaaactcctctgtttgtgctctttctctttatttctcagattggctgacacttatggaatagaaagaacctacgttgaaatattgggggcaggttcccacgatatcatcctgctgcaaataaagaggaaagtttatgtaaaatcctgaacagcgtcagatgtttgagtaaagagaatgacaactggcataactgatatattgctaaagcttcttagaaaaacctgagttttaaatataaaagttgtgaagatattggtacactccaagattcctgcaacatgcctacactgaaattcacttttatatataaatagataattcattttacagcatatagataaaataaggcacaatctttttcagaaatcatgttctttccataactttgactatttagcaggatagacaaacattcaaatagaatgtttgttcaataaacaaaagactgtaaaagggaatggcaatggttaatttccagtagatacaacagcacagtctcttatagtgtctaggattccctagaactttattgtttctaaataagtctacctcaaagcatctcatcaggcgatttcataatgtatacttgtagactttaaagaatcagcccaaatgaaatcaaggtaattcatgaatgttatgtaattaaaagaaaggcattgaaaaaatatataggtttcttggattggaggcgatttgtagctgaagagtaaataaatatatataaaatgtatcatttggaaatacatgatattttaacttcaggagggagacttttatcatttagaattatttctactatatataacaaaaacaattctacaaactcagactgctttcaagaataaggaaggttatcgtacctaatacaaaactgaaaggttggcaatgactcaggtttggataattcaatggctaatgatgctttctgtctaaatactctgtcataattactctcagcttcatcgtaaggctgctgtctgttgaattttaagatggctgtccacaggagcaacgtcgttatttttttaaaaatatccagtgggagacagataagccctcaaaaaaaaatgagtgatcactccctcaattttcccaaggattgtatagctagtttctttttatattagtaggatatattaattaatttcatactatggatgccttcaaacattcattcttttatgaccgaacatgtctaggaagggctggctagtaagctaacagaatcatattagggctatgataggaaagaggataggagatactgcataccccatgggtaggaagccaatggtaaccagtagatatatttattgtattgcacctatcaaaattccactgcaagatactcccttctttacttttaaatctggaaagattgatcttggtttatcactagtacatttaaagatgggtgttttatatcatttatcttccttcaccctgctgggtctcagtaacaatccttgaatattatttatcttggtttgattcacattttctcagcagttgccttcaacgtggctcttgtttcttcacttcttatttattaagcagcaaatgtatgacattgtttggtttagttctttccaattcaattcaacaatgtttgcctcaaaccatccttcttcattgagccatctttatcctgtactattctcttcttctcacttgggtacattagcaatgactgtataataggattcaatttcttttatctcccatgcattcagaagtcatctgatatcatttgcttccatccattttgggtccgttcagagattatttatcttgatttcttttttctcactgagaaattatggagttaatgccacatgctagccttttctgtaggacactatttctgatcaagatattagacatttacacatgaacactctagagactactcagcttcagttgagtcagctatgtattttcatcacatcatacaaattctactaaaaatatactctaatgttgaaaaatagaaataaaaagaagtgaccaaggacatccttggggtagattacttaaagcacacactttaaaaaatattttttttcctggataaaattctctatatgtgattgcaggcaatattttgcagaatctgcctcttactcctccaagaagaaaacaagattgaatattttatgaggttctgacaaagtatttacacctcattggtaactgttgccttcaatataaagcatctgcaagtacaaggtctggatttgccctcagcacaagcattgaaatttgcctgcccagaagatatgctacaagacatcctttccaattccagttaaagtttaacattgaaaagtctataggtaaagtggctgaaagctttataattgcatgatggacaaattatattcatttaatagctaatgtacatagttctttgctaatttataccaaaaccagtcacaactctagctcatcactgcattcggtaatttacatttcaaagagactatctggtactatttcaaagagtttatgtttttctgattaaaaaaaaaacaattgcttaaatctttttctctcctggtgttctacttaaaattcagttatgtatttaaatcatttttataactcagtgtttttcaatagtaactcccattagaacttctgagaatattctaccaggagattctaccttgttgcttggcaggagattctaccaagcaacatgggttttttgaaatggatacacatatagaaatagattcacacatataaactctaagatttgtttttcaggttatgtaaaccatttggttttagacataagaattttggcaattttacttcagattatattattgatgccatcaaggcccatctcccttagaaatataacaattggggtgctcacctggctaggcaggtaaacagtggtcatagtgacatcagataacccgttagccctcatcagagtctttaaacaactggtgcaacactgaagtggtaaccttttctggttcatagaatctttgagaataaccctgatttcatgacatttcagagcacgtcataaggacagaatatatctccctcagagagtgatacaaagaatacaaaaataaaaacatttaaatatgcaattgcaaaatattgtccatactctcttcccatcttcccagttgtattttcttcccttcaccataacattatgtcaaaaaagaaaaaagaaaaggaagggaaaaaaggcaatagagaaggtcatttctggttcttttagggaaatttatcattttttaacaatcagtggtctacactgccaattaggtgatattgtccagattccagagtatttcaagagggtttgcaatgttgcccaaattcaaaactgtcattgatatattctctgtgctttagagggtctatattcaaatagaatacaatatgaaagagccttctggaactgtgccatttagcggtgctggttctaaaacctaggtacattctcacattgtctagtattcataaatccctagttaattgggtgtcatatattagagaacaaaaagcctgactctcattaagaagtcaaataaaatgtggagtatggaagaaagaactctttagcagtagaatacctacacacagcctgagtgaacctggaggtttgtagcaaaaagaaaaataaggaccctttagtgaaagttttcctacagagctaaatttgttgaatttaaagaaatgttttttaattttccaattaggtcttggcaattttttaaaatgagcaaaactatgacaacaaactcatttaaaaatattatttgagatactatgagatacagtagtttggaaactactgttataagacagtaagattaaaaaaaattgattatcatctttcatgtatataccagctcactcaacttcataaccattcctggtttgaagggaggaaagaccagtggaaatacatttgacatgtttttgtgcccattatggtttattgcaattctattttgatgttagtccctcacatgtttactaccagacttctaacaaagacaaatagtaataatcaatagtgatgacattaaagcatttcattcaaatatttcaaagcacgttagagccatagaatctgctttatatactaagacagttttaaaagtttcataaaataatgttttgtggaggtgaatggcaattattctaattctgaaattcacaattgtaattcttgttttatattaagtgacttacaaagtgtaccataaaatataatcatgatgttattttcagtgttataatagtcaattatgtgttacattatttttattgttttactcgtgtacatgcaggattcttggaaggatttttgagttcctcaaaggcagagtttgttatatttcttttgatcaacgaaaaaacccatttcagggttgtttgcataattggagctaaggaaatacttcttatattctgtttaataatatgtttaactttgagaggtaaatattttaaaaatatttggaagcattaacctagatattatagacaaatttttaaaaagtttttgtaagtgtatatttctatcccaaagactgaaatagagtggcagagggtcgtgaagagagaaattaggttcaatataactttctgtttatgtacgttgagcatggaaatcaaaattttactgctacattttaaagcaataaactgtgctattcttattaatatacttcaaaactggtttaataatagtatgactatgtgatagctaaataaataaaataaggtgccacagtaactaataagcacagcagtttttacaacatgtagtgtcttaaactgtaatataattaagaaaatttactttaactgtcttaatttcttcttacttcaaatactttcacacaatccagactatccaccgaatgacatttaatttttttttcatattatgagttttttactctttaaccattacagaatttgctcttgctcttcaaccatctggaaaccttaaaatccaagcttttgaaagaactcaatgctagtgcttttaaaaaatggattgatttcttccatgctttctttgttctcttctataattaactctaagaatttttaaagcatttatattaaattttcatatctgattttgaagctacaatatgtattttcataaacatactgatattatgcctttgaaccacttccccacatttggaaataattgacagaaataatcccatgactaactgctattttataggtttgtgtagttacatggtgtatattttatctgactgtggccaattttatttatataggtgcaaaagtgttattcattaacgcacataagcctccttggtctatggtcagtaaatctaaagccctgtaaaatatccatatgatgagtctgcaagacgttatttatcttttctttctttttatgttttctaagtcatcttctctgagaacaaaaaaccacctatttctactagtttttgtcttcagtatttacaagagtttttccccttcctccaagatctcccaaatttgtcagtgccctagtatgccgggaagtcatatttaatgcctgagaggctttctaagaattgtttccacatgtgaaatacagaccctattccttaatggtgagcttgtcagaccagattagttgagatttatattaaaatgtgacatttctgattgagttcacagttacaaattcagtttgtcctatattacatcctggtaggagtatgcatttttatcaaacacagaaataagtgcattgccataaatgtaaagaaagccagtgaaggcatcctgtatatattctagccaacatatcgaggaattttatggacacagtcaattcatatctgccattttgtgcagataacctgtcttttcaaaacaatggggggcactttcagtgcttatttactttttattagcaaataaactgtgcttttaaaatgtaaaagtcatgaatttcttaaattcatatctttagttctttgatcacttctaaatcagcactcttcattctatgatttatcagctcctggaaatgtatagccttttactaatgagacaaatttttctgtagacttttaactttgttacttttcttttctcttgtgaattgcatttttgtagaaaattgttaattgtctttttaaatttttgtgcactgataattgaaacatttcctaatttgataatttacttatagcataaatattatatctgcatcttcttattgaattcaaacctacaactcaatttcggctacctactaagcctgttatctaaataggttttcttcctttatagggaggtaagctatccatcttactttagaaaaaaaaaaaaattaatgctttcagcttgagtggatgtggaaaactattgttgtactttaattaagcaaatgcattggggggaattttgaataaaaataagaaaatccattagagataattggaaataaggtataattttagtggtacaaaaataaagattgctctataaatacaccaatacataatgggatttcttggctgattcagtatttacaagtcataaattcacttgcaaagatattaggcaatacagaaactgcaagttaaaatgatgaattctctgtcagatgaaaatcaatccaaagtaaataaaacacatctcaaaaattataaaactaaaacaattcaaattataaattaaattttaaaaattattaatttaggattttttaagaaaactattatgttcagtgagctgttctttgtaactctttctataaaatgtagtggcccaaaacaatgactttccctttggaaagtgattgctttagtcgtaaggaataattttaatatttagagattttttaaagtgttgctattttagtccaatttggattgctgtaaaggaacacttgaggctaggtaatttataaagaaaagaagtttttttggctcttggttctgcaggctgaacaagaaggatggcatcactatctgcttctggtaaggacctcaagaaggttctattcatggcagaaggtgaaggaggaacggaagtgtcacaaagcgagtgagtgaggagcggaggaaggtgtcaagctcttttgaacaaccagctgtctcttgaactaataaagcaataagcaccaagtctgttcataagagatctgccctcacaaaccaaacacctcctaccaggacccacctccaagtgggaatcaaatttcaacatgagatttggaggggataaatatcaaaaccatatcaattggcttcttaaattggtgaggttgcattaaattggaattagacctgctttttaaagagcttcataaaatgtttctttcagatcagtacgtgctgacttattttgacctttacaggaggagtaaggattcaccgaatttttactttttacaggagactttagagaccatttaactgatggtctttatacagttgcagtcactatgggccacacagattaaatgatttcagtcacacaatcaatagcaatagtctggtgctctagttgttttaaacactgatttggtaacaaatcagttaccaaaatgttagctaaaagggtagcctcttttttaaactgaaaaagtatatataaatatgaaagataaaaataatagaaaagtagaagacagtcaaggggtttgtatatatctaattgagccaaatctcttatacagcaggtcctcaaataacattttgttcaacatcatttctttatgatgttgatgggaagataaaattggttcctggccagagccactgtctgtgtggagtttgcacgttctgcccatgactgtgtgggttttctctgggttctccagttttctcccacatcccaaagctgtgcacgttagatgaattggtgtgtctacattttcccagcgtgagtgtgggcatgggtaagtgtaccctgcaatgggatggaatcctgtccaaggttggtttccacccttcaccctgagctgtcaggattctccagctgggaatcaaatttcaacatgagatttggaggtgataaatactgaaacgataccaattggtttcttacccctgaggttggactgaaccttaatgaactgaactgaatcctgaactgtaataattgggtatataattatcatacttgttttattaatctttcttaaatgtattatagctcacatttatctcaatgtttaatattagaagagttttagtctttatttagaagtttgatgatgattttgtgacgagacatatgccatagaaacttaactctcacttatatcaatcagcctattataacattggtttcatcataggtcatttcacttaaacttgcagttgccaagcacctattgacgatattaactcaggacttactgtatacatgtttgggttcatttatgtctatgtgtccatcaagaataaatcccatacattattattatttaaactattactttcaaactcctcctccatctatttatatgtcatctatcattctcctaataatacattagcttttctacataccacttaccaaccctcatatttcttaattctcaatttatagctcattatcaggtattctggtcataattggatttggctagtagcttattaatcttttcaaaaataattcggtaataacctattatatacacaatgtgggggatacattattgatcagggtagatggaattcctttcctgggagcacttgccatctagagtaggggaagagcactctatgaaccgatgctagtgcttaaactgttagttgtttattactgcataacaagttatgtcaaaatttagaaggtgtaaacaacaaatatttattatttcccagcttttctaggtcaggaacctggttatagtttagcagggtcttctttctcaaaattttacaaggctgaaatcaaaatgttggccagggctgtggtctcatctgaaggatcacctaggagagtatctacctttctttaatttcactcacatggttttggcaggattcagattattgttggttgttagactgaggatctcatctttatcactagcaatgggatgaaggtctccatcagttccttattatgtggacctctccatagggaaaaaattacaacagtgtttctaactttcatcatagtaagcaagcaagggagaatgaggagggaaataagatggaagccagggttcattcatgactcaatcttggaagagacatcccatccattttgtgatattctgctcactagaagaaattcacaacacctgattcacactcaaggagagattacaccagggcatgaatcaggaattattggtagttacctcagaagctatctaccacaagcttgtattatataaaaatatcagtatgtgaccaattggaaatgaaaatcaaaagacaacattgtgtcaagaaattttatttatttgcttttttgagacagcgtctcactctgtcacccagactggagtgcagtggcacgatcatggctcactgtaggcttgacctcctgggctcaggtaatcctcccacctcagcctctcgattagctgggactacaggtacatgccaccttgcccggctattttttgtattttttcgtagagacatggtttcaccatgttgcccagaccagtctcatactcctgtgctcaaacgatctgcccacccaaagcaaagtgctaggattacaggtatgagccaccacgccaggcctgtggcaagaattttaaagggattcagattttactctgtgtttgtgtccaagttaataaattagagagtctgccacagtctcatagatctggtaggaagaaaagggactctcggcacatagactaaagacagtttatgacttgtagcaataagagtaggcagagtatttttccattgattcacggatctgattctcagataatacgaaggctactgaattgcagttacacatgcagtgaactgcactacaaaagagggatcctgaatttaggcttccggatctttttaatgaacaataagcatccctgccctttcctccaaagggagatactatctttatgttcagattgtagaaaatttatgtttccagaaggagaagataaattatcttctaaggctgtgcactgtacaaacatctttgaaaatacagtttggaataaagggctttaagtgactctgtcacccataagacatgcagtaacatgagagttccgtgggtaattatctatcaacatactgggtcttcaccacagacagtatgagaagcactgaactagaggttttaaactattttttaaagacaaatctcacaatcactctaaaatcactgaggtttatactactaagagatagtactagacaagaaaactttgacttatatatgttttattcttttttaatatttgagtccgaggtaagagtgtgtaataaagattctgctacaatgttgaaaagaactacgtagaacctgagttgagtgggagaaagattagccatgcttcttaagcttggctccagccaaattcttgcaatttcatcaagataaaccacaaattggaataagaacaacaatccttgagggagtgctctgaagagcttgcatcatgatgtatgtttacaccttggaagacccatgaaatatcacctattaactttatagcttatttcacagaagagacaacttttgcaatgttaaacatgaaacactgattgaaatgggaagaccatgcaaaatcaactgtgtaagagaagaaagaggcattgtggttagcttctagaaataacagaaatcaagttagtaaattctagaaaaagtatatgggccacaagaaagtcatggagaagtgaaaaatacaataagaaaacacgaaaaactgtgaaatcatttgcatgtttttagtcaaaagagtgagaaaggcaaagaatatggtggaaatctaaccaaataaagttaaatataagttaaggttgcactgtgcagactctacctcgtaagaatggaaatatattgggggaaaaggtcgtgcaaattaaataataattaaaagcacttctgaatatagtctaatttgctccatcttaagtgaaagtcttgagaggaattttaaagagagttatacttgagagaaacaatgatgtcttgaaggagaggattttgagttagatacacaaggatgaactttaggtactcaagagggatttgggggatccctgttactcttccccctgacattgtcaagttagaatagataataaagaaataagttagatcttcatagtctcctctctgttctttggtgctatacagtaagccagatataaggaaaagttgaaaatcttgactttgattctctctgtaaactggactgagattggtgcagaggtcgaggtgtcttgctacatagagtgccctccttgtttgtaacacctcccaagagtcatgaatgttgacccctttcacgtgtgtgtgtctatatgtctatatgtgcatatacaaatccatgtaaaaattacaaaaatatagataaaacaatgatctgacttgcaaatttccatcccaatataatttctgtttccagatgtgcatatgatcagtctggtatgtatttcttcagatttctacaaagatatttatgtggtcatacatgtagacgtagaaatgagatcatataaaacagagttcagaaaactacagcctgtggaccaaatcttgtcaacggcatgctttactgcctgtgaaccaaggaagatttttatattttttaatggttacattttaaataattatataagaacctacataacaacttcaatgttctctcctgccctgcaaagccttagatatttaccatctggcccttcaatgaacagtctgccaatccttgacatagaataaaccttttcctaaaatatctttatctacatttaaaaacatgtcttggaaatctttctgtgaagctatcttattcattttagctgaaagatgatagtccattgcatgaattattgttgcataagccattcatctattgctagatacaaaaatattgttccattttttaatattacaaataattctgaaatatccactctttatagttgcctttgagtgcacacaggcaagtatttgcacatgaatgtcttcattaattttataaacacatacattctccacaaatttgagggcatttcccacttctaagaattttaccaaagtcagacactcttggcttataactttatgacaattattaaatctcagggagaaatgtaactatcatgtggacagcagtcttacatcagcaattataatacacttttgcatcggcagtgctgtaaagaatgaaccgttataaccagtaaagtgtttggtgagcacagaagtaaagcaagaagtatcacttatataaacttaatgcttaaaagcgtcaggctagttcagtcgggtgtatctatcactaaaatagggatagtcctgataatggaccatcatatgatagactgagtattcgttatcccatacacttgggatgagaagtatttcagatgtcagattaaaacaattataatatttacattccaataccatttgacatggtttggttctgtttctctacccaaatctcatgttgaattgtaatccccaatgtaggtggagggacctgggagatgattggatcatggatgggtggagaggattagatcatgggggcagatttccccctggctgttctcatgatagtgagttctcatgagatctggttgttttaatgagatctggttgttttaaagtgtgtagcacttcccccttcactctctgtctcctgctctgctatggtaaactgtgcttacttcccattcaccttctgccatgattgtaagtttcctgaggcctcccagccactcttcctgtatagcctgtggaactgtgagtcaattaaccctcttttccttataaattacccagtctcaggtagttctttagagccatgtgagaacggactaatacaccattcaaaatccaaaatactcccatgagcatttcctttgagtgccttgtcagccctccaaaagtcagatttcagagcatttcagatatcaaatttttacattagggatactcaacttgttttggctactccttcttttcaatagactctgtaagattcttatttaaaatatgcaactctacctctgtatactggcacagtataggaacactcatcatttcctgaaagtgaaaataaatatactgacctgtctttgcttttgagattgatattcagtggcgcatgattagaggagcgtgtattataggagaatagatgaaatttaattaactaaattcatgggattactatgtaataataatgaagtcatattacatgtactgttgaaaacacttattctagccaatttcaagtactatagttaatttgtagggagtacagagtgaatcaactagagaaatatgcaaaagaataacatatttaaaaagacgaagtatgattttgaaacaatatgattaaaacagcacatttatttacctgctcacaaaggttttatctatataatgtcagagcatatattttaagaacatacactaaccatattccagtaatttcatggctatcataaaaaagaaagattgaacactctaggctgtcctaaagcagtcattttcaaatttaaatatgcatcagtatccttggagagcctcttaagacagattgctggaacccacacctagagtttctgatttggttggtgtgatggctttttggtgtgtgaacttggctaggctacactaagttcctcataattccttcttgtaggtttctacatagagtgggctaccagagatagcctcttaagagttggaagaaggaaggaaagcagcagccacttcgtaccatacacaaaccaccttttcccagtgattcagtgaagcgctgatattagtactgctgtgaaaggatctggcaggtgtaattaacatcctaattagttgactttaaggaggtcatttggcaccattgtagaaagcccccactaggacaatgcttagtggaggcttggagagtgaggcttcccccaagatgccagacctgcagagccacaagtgtgcaacaactctagcctggaagagctacagaacctaactccaaccgctgagagctgccgtgcagcctgcacccagcaaagtgatgatggtgggctgccccaggccttaggggaccaacctccaccccagtgtgtccagatagtcatgcatagagtcaaagaagatttttctcaagcctcaagatttcatattgtttgccctattgagttttgaacttactcagggccttttactactttcctcttatctatttctgctttttggaattggaatatctatttaatgcttgtcccaccattgtattttggaagcacataagatgtttgatttcacaggctcacagcttagagagcaatttgcctcagaatgaatcataccttgagcctcacccaaatctgatttacataacgtttagatgagactttggacttagactttaaagttgatgctggaaaaattaagactttgaaggctgttgaaatggaataaatgtattttgtatgtgagaaaaacatgaatttcggaagcccagggatgaattgctacagtttgaatgtagtgtcccctccaaaatttatggtgaaacttaattcccattgcagtgatattaagagagggtctttaatgagttgactatgtcatgatgactctgctctcatgaatggattaatgctttataaaagaggctttggagagtgtttgctcctttttgttcttatgctcctctgccatgtgaagatggagcagacacacaacatgcctgtgcttaatcttggacatctcagcctccagaactctgatgaagtttatgttctttatgaattaaaaataaataaataaattagggagataatcttgggtggacctgacttaatcaggtggaaggccttaaaagagtacctagaatttccatcctgagagagggattgaaaaagaaggggaggggagaggaagaagggagaggaggggaaagtaggagtgcagagaaagaggagaggagaggagaggagaggagagaagagaaaaacagaagacagagaggaagagagactcccactacggacaacagcttcatcccgtgctcatggggttttagcctgccagcttcttataatagattcatctctctctctccactgctggtctggaattacattttgaaaatcactatactaaaggattgaacatgagccaatgtgtatgaattacctagggaaaaatattaaacataagatagaggtatcaaacaacctggaattttcagtaatgagtaatctgccttgtgtagaagtatagtttagttctctctattacaaatgttcaagctgagtttggataataatggcacacaccgagtacttaccatgtgcctggcaatcttcacaacacacacatatatacactacccaagtattttttttattatggcactcagagagtatacataatttgctcaaggtcacagcagaggtggtaaaacttggatgacaatgagacagtctggctgaaagcccatgttctcctgaataacagcaatactgccaatgtacagagatgccatcagatacagaagaaacagccagcttgaataattctttcattttactctttttttccccactctcagaattgactcctttgattatttgtttgtgtaaacagtcttagttttataaacatgaacactaagccccctggtgacttggataaaatgttcatattttaatttttgtaataatacagattataattttttctatcacgggatgactcaagtgaatttagacctcagttccttttttcatattgatatttgtgtttttctgaaaacttcaaagtgtgcatacagctctgcttaaagaagtctttattatatggtacatgtttgcagattaaaggttccagaagagaaaaggttttcagggcccaaaatgttatcagtgaactatatcatctttatcattaatcatcatctgctatgtcatgcttgctctccatctggttgggtatcaggtgtgatgttgaatagtttcagtacattaattcccaactagtgactactggtggcaggcagatcaggttattctgtgagtatttattgactctgttaattgtttgacaaatcattgttgactaccatacacagaatggcagatggccagtaaagtgttaaataaaattttctgtacttttgtgatctctcgatagatcttatatttaaaaaaattaaaaagaagaagcattctttatttaagaggatgaatgaattatgatataaaatcaaggtatgaataattttagtatgaaaattaagcctgatttaaaatagagtaatgaagatcaaattaaacttaaatgctcacacaattaagggttgttttcaggatcttttgagcttccctgataataagtttattagaaagtgttctagtaatcaatattataacagtagaagagtgaacctgggaaagaatccagagagagtggaatagtccgtggcacaaatgctttttggatggaaaaatgaaagtgagacaagggtgaatttatgttcttttccagtgtttttacacatatgaaatttcaaaatagcctgagtaagagaaattcagtaatggaacatgtttaattattttcacctttaaaacttcagaaaaataaatttaaatttcaaaaatttgctgatggagaaatttgaaaaacaaatttaggaaatataatgtagaatgatctgaatactgggaaaccagtcctaagaaatgacaatgaactgtataagaaattcacaactacatctagaacggatttccctctttccttcatttcatcttgtgtctcattcaccactgccttcctatattaacttgcctaatgcaagctgatttaataaataaacctcaaaagttcagtgacaacacaactgaagcttatttcttgctaagataacacttctggtgcaaatgtttctagtctgaatgtgaatttcttccatctaaaggtttagagattcattttttttttaatcatggaattctcccattgtctagcattccagagtcttctgtgctgagatcaaagaaggtgaaaaaaggagacagtgaagaagatattcacacttcttaacctcctcatactagaagtgacatatgttactttcactgacattctgacagcaaaaaataggcatatgccctcacttaaatgcaagggagtctggcacatgtagtttctgtctgggcagccagttcccagccaccacactattctgtggaggaacggcatacattttcctgaatggttaactctctctgacaaattatttcacagatgttgtgtttatatttgtggaataaataggttagggtgacatttaattggactaccctctgggagaggaaatgatcaccaaggtgagaggtcatcagtgaaagttatggagttttctctcttggataaatggcaacaggtagaagcaggtgccagctgctgtcctgcttcatcacgctttaagtctccttcttctgaattttttttctgaagtctaatgatcaaattacaaagttcatgaggatagcgttcaactgcatgggatacttgctatttcaaaactcaaaatactcatccattccatgaagcttttctagacttactgaatctcttctaatatttccttatatttagcttctgaaatacctcatcagaatggcatcttcttgatttgtgattcagctgtaattagcagtgcccccttctaaattatccttaagacttttaattgtcttctaattctttctcccaccacagtctctctgtcaaacacatcaacaaatatatcatcaaacatcatctacatactatagggaaaagtcctaaagaggtcttgcagtgacttaagttatgtttaaaatgtttgctatgttaaaatatatcaaatgcttattagtccaaataataatgctaggatcaatgggtggggattggagagaagtagatcttagtgcaatatgagcagacacttatagagagtcaatgaggtataataggaagtacactgaacttggaatgcaaacacttttgtttgtatgtctgcaacaacatgtattgtactggctgttgtggtatcagagagatcagttaccctctttaaatcttaatttcctgatgcataaaatgaggattattaaaaacaatcttttccttctactatacgatcacatgactatcaaaggtaatgtcagtgagacccttttctaaaccgtaatgtgctgctcaaatgtgaaattatcacctattagaactttatcttaatggaacaaggtttctcgccaagtaagagattctctttcacttgagtcacggtggccattcacactgggccttccatattagctggaggttaggatgagtgctctcaagggtctcctcaaactgggagatcatctggttttattcctgtgaaactcttcattttgcaggtaaggaaatcagagaggtaaggtaactttccccaatgtaattgctagagccagaactctcttatcataaatgacatcatttttttttttctggaatcatgtgggcttcgatcttagctttatcttggcttcctttagccctttctgtcatcttattttgattgctgttttcttgcctactgacccaagagcacatgctttgacttcatacacaataattcctccacactttgaagagatctaagtaatatatctatcaatatcctgatggctcaactggtttttagaagatataaatcattcaaatgactgtttcacttgatactcaagttcagtatgtgttctaagcttaagttaaacttggtatggtcatctaggaattgtactagcattgatacagtataacaacagtactagctacatgaaagactaaaacattacagaatgattttacaatgatccacaatgtctgactatataaattgaaataaagaaaaatgtcattacccctgtagcatctataaatattaatatatttaaatttttaaagactggtattttctaatgtctaaggaaatatttttcaatgaaataagctttcagtagatatttactttgactggtttctactatgtaaaataatagaagagaagatggtttccccattcaaatttagcagtctaatatgatggcaatggagtgggagaacaacaatagacgtaatcaattaccaatgacttggtctctaagtttgtctcaataaatatataccttagcatgaatcaagttactttattttaaaaatctgcatcagagaaatgaaattacatgattttctttagtatttgttggtcatcttcactgagattatcaaatctgttaaattggaaatattttctttctctgcaatctcaccattaaaatactccggttctcaaactcccaatttggaaaaattaatttcatattattctaaatttagagaggacaatattatgtaattttaatagaacaaaaaggcaaacatatacagtgaaattatgatgtattgatctgttttaccaacaaatcatacttgctaatattgagaaaaaatataattagaaaattctattccttgcatattggaaataatattttatgtctgtagcctttatagcactctgtttactattccattgaaaactttatctgggcattggaaaatgcaggaaaagactgttgatagactcgtgtatcaatactaggcaacctttttaaatggtttattacatttctgacacttgtgattaacaagtatatgaaagatattgctatttacaaatttcataactggataatgtttcttaaagctgaagctttattagagtcacatgcttgaaaataacttcatgaaatctcagcattttctccatccattgatggcttagcatatagtgtggtccttaaatattagttattattatcccagaaatggatgagctgagttagatgtatgtaacaagtcacaagagaccacgtttgttcttttcttgagtctttactcaatatattgcaagctacataaggaatttactatcctcatggagaaattttaacttttaaaatattctctttttgttcttcattctttaaaatgcaaatgttggctgtcacaaaacaaagcagtttatcactttctctcagagaaaatattcctgtttatctgcacagatgtgggattaatgactagtacttttgagttttgcccacttaagctgtctgatgcccacaacagctgaagtgctcaggttcttgcagccaatatgtaggcaattctacacccactccatgacatcaagcctagaattgttatcagactctgaattgaagaaacttttgcttctccagtttttcatacagaatattagaaaattattgttggaattagttttcgaatattttactcacattgcaaatagtatgctagactttgggaacacaaataaaatataattcttaattttaaggcaattaaaatcagagagagatatataaacacattactatttatttgtaatgtattacttactatagtgtcacattttatcatcaataacttgattacacagatggagagcatcgtatcatgagaggtgagtaggaagttttcagttaaaagttgcagtttcggccaggcgcagtggctcacgcctgtaatcccagcactttgggaggctgaggcaagtggatcatctgaggtcaggagttcgagaccagcctgttcaacatggcgaaacccatctctactaaaagtacaaaaaatagctgggcatggtggcgcatgcctgtagtcccagctactcaggaggctgaggcaggagaattcacttgaacccaggaggtggaggttgcagtgagccaagatcatgccactgcactccagcctgagagacaggttcaaaaaaaaaaaaaagttgcagtttaaagagtaaggttgaatttgaagatgaagagaatggaacgaaagaaagggagagatatgaagagatagaaagggacactttaaatatataggagtccaggcaacatacaaattataataggatttatgggacactgggtagcaagattagcaagccagatagcagaagcaaacagtactaggtgattaaataattttctgataagttctaaaacttttaagaaagccaaaattctaaaactgataagaaagcattggaaggtcacactctccaagcttaattgaaagcattggaagttctcactctcaccacccaacctattgggacaatatccctctttggaactctggcagctacattagtattacatatttaattaatttattatttatacatgaacttccttgtcatatcttaaaaattcctttgtcttaaactgcaaattaagccttattgctttacttttcacatacataaactctttgagggcagggttccaatataataatataatgtacgccctatattgcatacatggctcacacatagtcgctatttaatagtactttgtttgttaaactacatactttgtgtggatatttgttttgatttgttacccccaagtaatcttgaattttgtttcctccaaaaaagacaaaattctaacacccagtacctcagcatgtggccttatttgaagacagagtctttaaaggggttaaacaaattaaaataaagtcattagggtgggtcctaatccaatatgaccaatatcttcataaaaagaagaaatgtagatacatcaagggaagatggaagaagatgaccatctacaagccaatgtctcatagagcagattcttcctagcagccctcaaaaggaaccaaccccaccaacaccttgatttcagatgccagcctccatatctgctagacaataaatttctgttgttgaagccacccagtctgtggagcttttcatggcaaaagccctagcaaactaatacatcctctaaaatgacttcacaatcctattgaaatctttcaagcatacatttttttataagtcacttaggactcaaagtttgtcaaatccccttaattcctgatctcaccaaataattgctcaatctctgcttctattggcatgagaagacctgactttactgatacatagggaaagtgtcacgatatactttaccatttcaaatgcagctcatgctcatgaaagaagttttataaataccctcaaaggttatttgtcaaattgccagttgtcagtcatctctcaattacccatgtatgaattattcagagctggtttaacttcaggctgatttctttttgcctccaagcacacatctgatctcactctctgttccagcaattgctatgtgcttagggaatgcagactaatgttaatattagcccgagcaaacaattaaaaggctaaatctgtgtctaaaagaaattaatgcactcccccaaacaaacatgtatcatctttgtattatcagatgttttggattatttaataccacggctcgtttccttgataattgagtctaataagccctatgcttacactatttataattttgggttataaagccttaatcatcagtcagatgatttttatttcagttttctacagtgttcaggacagcattacagtgcctgctaatataggttgacaacatgatatggtttggctgtgtctccacccaaatctcatcttgaactgtagttcccataatccccacatgtcatgggagagacctggtgggaggtaattgaatcgtgagggtgcttatccccgtgctggtattcttctgatagtgaatgagttcccgtgagatctgatggtttaataatgggcttttcccccttttgctccacacttctccttgctgccgccatatgaagaaggacgtgtttgctttcctttccaccatgattgtaagtttcctgaggcctctccagccatgtggaactgtgagtcgattaaacttctttcctttataaattacagtctcaggtatgtttttatcagcaccatgaggacaggctgacacacaacacaagactgaattctatcctgcaatcttaactacttacattagaagaccttattgtattctactctcagctctgaacaactcctgtctctttggtgactgcccatccttgacgcacaagtgagtccaagttgccatttcatgcaacattatccaccatcttcccagcccttatttctggtctggggatagataacagattcaagatagatgactctaatttctttcctaagatttttggaatttgggttcagtgaatgaatccatctcttcaggtgcttagatcttattatgtaaattcagaatctgtggatggcaaagttgtctggcttttgaactgagaagcagacagtgtaggtcaacaaataagagaaaaaggtgaggtttccaggctctgattggttttttccaggtgccctgttgcaattctggccctgagtgttgtgaaacttctccatatccttataaattctacctgtttgataaaatgaagcctggttatggttgtgtttcccacaactaacaaagcaatcatccggccaaatccccttagtttaaaaatgagaccattggagtacaggaaagctaagttgtgggtccacattcacagataatttgtattaggactaggaaaaaggcatgtaactccaaattcccaggcaataggttgttttgagataactgttcaatgcagttgtcaatcctcgaaaatagtagaattagagcttaataactggtaaatttatctcttactaaaaataactgtcatgtactgaatggttgtctagtatgcactatttacattctaggcccttgagatatagcaatggacaaaacagatgaggtcgctgatctcatgaagcttatattgtgaaaattatactccatcatccggatggttgagatcctttaaattttcctataagcatgactacatttgcacaaaagcatctcttgtgtggagtcttccctgagataaagtttatgaatatgcaaaatggctggctgcagccaccggtacagtttgttccccatggaatgctgagaagccagctggtcctcagaatacaacaggaaagggaaatataacataaggtattgtagggcgtatttacacagtttgtgccccatggctcagtcctgtccaatatgtcagcagactgagaaagcttaaggaattctatctcctcagagaaaacagtggttgtaaatatatactaggcttcttgcactttttttttttttttttttttactttggtcatgagtctatcactaattgctgtagaccccctggcatcaatcaactgacatttatgccctagtatttaggattctcagtatttcaaaattgtaaaactacatttgcaagcacaatcattttaactccttaacctcacgtttaagattgtccatggtcgggctgcaaggtacctcatatgtattacaagaatttagtaactggtaactgaaagaatgaattatttcactgttttcctccaactccacatactcaggtcaagccaaaatatttactcttcctgcatacttccaccaccacccacccccatggttcttttccatctaggcctttgattctgcaattcaatgtcctgagagtacctgcctcctatctctgagatgtgacagcctcttcaccagctgctgctctacctgtcttcactgatggtaggacttgtttaaagaagctgaataattcacacatgtgcttgccttacattcgttattcactacagtacatagctatgtgaccttattctgaccaatgggctatgaagggaaatttgctaagaaagaattttccttcacgataaaattaaagtgtgcaaaagaaagccccttccttcctgttttgtctgtagaaaataattacagtgagaggtgaatttgccgaagtcagcttgccactctgactgggaggctgaaaccatctctgggaaacccagtcagagtcccaccattatttggctacttgactgatccaggatccaggtgcgagctgtgtccagacttcttgttacaaggggaaaatgaatctccattctaaaaccaccttcaactgggtattttggcacttgcaccaaacccagtgtacccttttatgtttagccctctatatcctgtattaaagttatttccttataacttacatttatatcgtacattataaattactaaagtgttgttctcccgatggttaaaaaaaagaacaaagtgaagctagaagctatgtactgtttgaaggcacacaggtggcaaagaggaaggcaaactttaagctcatagcatccttgaggtacggcttctcttgaataattagccagatgctggtgatttttaccaatcctacattttcatgggttcctcttttgcaattagcctttcttccagaatttatgtcagtgtttgttcattaatgacttcataattcgtattacaactatgcctgcccgtgacttccctgtggagttaattccataaacagcccacatattaagacagtatagtattcctcagatacataagaagcaggatagcttagtagttacacctggtatgtagtaactcacagtagtagctgtgagttaaagtgttggattcataccctggctccactttaattcgctgtgggccaaagaaaaggtaacggtagaagatacgtttgaatcagctctttctttctctaaagcccactataacactcattgcttatattgttgcaaaaaccatttcataattgatgtttttctaaccccagaatctggcacacatggcacagtatcttagatatagttgatattcaaaatgtgttcaaatgaatgaaatttgttaagtgaaagtcacctaacctttcttttactgatattagtacttactaatccaagttgcctcaagagaatatacaaaggcaaataataaatactgaattctttatttttagcaatctggccttgttataattctcacctctctctcccaaatcataggaatcatggttaaggtaaaatatcttttgtagcccccaaaatgttacagcacaagaggtttgagtttttagtaatataaaaatgcataattgcccacagcataatttctttcaggccttaatcccatgggctcaatctaaggagttttaagtttttggtttttgtttttgttttttcactgtgttaacctgttaaagctcatcttagcaggtttctttgctctgtctcttcatatgcttttgagtgtgtggggccacagttactttcagagtcttatttgctcaagaagacataagaatccagttccttcaagaaaaaagcaaattaaaaagttattaaagcatgtatcgccacttgacaagcccctctggatccatttgagcttatgaccatggtgagtcttcagaaagggttttatttcacaaaccactgagcccttccgagccacatgctgtttgataattaggggctatagtatctgtgatagaaacccagtactgaagaaaacagtgaaagagactaatatagacaaccagctgttgattttctgccactgtactggttgacttaaactatgttgccatccaaatttatgttgagccaaaacccttttattcacagtaatgtgatggcaaacagaatattgtgacatccaggctatactgccatatcaatagccaacatctgtgtggtctttgcaatttacgatgtacttttacatcatttatcctatttaaacctcacaatatccttgtgaactaggaaagtgtgacctccttttggaggtgaaacagatatacagattacatgactcgtaaaaggtctaatggtggatctggaactatctggcttctacttccttcttcattgtcatcctcatcatctatgcttcaggatttgggtatctgtagaaacttcaggtggatttttcctattttcttatgtgagctgtgctgaagtttctacctttgcctatagcagagtcatttgaataacaccacacagcgctcctcctctaactacctttgattgaacaccattggtgctttgacccattgtacatgggggtcagcccaagttaattggcaattccaaaccaccattctctgttgagctaataggaacaaaaggatcttatggcactaatttctaagagatacttcaaaacaaggcaacctggctgttttagaaatttctcccttggtaactgccttctcaccatatttcattagctttaaatttgcagactatgaaagatgaagttttaccaactgaaaacacatctaggaaatttttccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagcatggtattggtaccaaaacagagatatagatcaatggaacagaacagagccctcagaaataacgccgcatatctacaactatctgatctttgacaaacctgacaaaaacaagcaatggtgaaaggattccctatttaataaatggtgctgggacaactggctagccatatgtagaaagctgaaactggatcccttcctgacaccttacacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccagaaaacacatgaaaaaatgctcaccatcactggccatcagagaaatgcaaatcaaaaccacgatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaatactatttgatccagccatcccattactgggtatatacccaaaggactataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaattgatgagttcatgtcctttgtagggacatggatgaaattggaaaccatcattctcagtaaactatcgcaagaacaaaaaaccaaacgccgcatattctcactcataggtgggaattgaacaatgagatcacatggacacaggaaggggaacatcacactctgggcactgttgtggggtgggggggtggggagggatagcactgggagatatacctaatgctagatgacgagttagtgggtgcagcacaccagcatggcacatgtatacgtatgtaactaacctgcacaatgtgcacatgtaccctaaaacttaaagtataacaataaaaaaataaataaataaaaaagaaaaatacaaaaaaaaaatacaataataatgctaaaaaaaaaaaaaagaaatcacctctctaatagttcatttaggaaagttctcagttttattaatctttgtgttgcctttgaagccaaacctgttgtattgcagatcctgcttcctggcagtcggaacacgtgtttataatcattacttccattccttgaaggcaacctttggactttattgattgctttatcttagttaatactcacctgacatccctgagttgtcctttatgacattggcagacaattttagcatcattgtctttaatataacacgttcaaaaaatgaagaatgtgtgattattttaatgaaaatatgagtactggtatttttagtatttctgatgtttcctttatgttcataaggagtatagagagattgctgtttttacactgttaccttccatcacttcttgaaaaggcaaagacaaggtaagtatcatacgtaatactgagaaatatatttcaaagtaaatatttttccttaattctatccctgttgtttcttctcttggtttccttcctttcttgttttctatctttctccctctaattcttcctggtattatcttgttttctatctttctccctctaattcttactggcattggctctgatgctgtacagaaatctaaaaaatatggcactaatttcagagaaaacgtggtgcaattaaaaatctttgttccaagtttaaattaagattataaaccaaaatgtggcagaaatgatctaaaaaccaagaatatttctcttacaatatacgtgcttcattaatacttcacaaatctagggtctttttttagccagtttttctcagggatttcttaagcttggaatgtatgctttggaagaaattatgaaaggttactaaagatacctgggacagctgtaaaaggaaggcctcagcccataaaattaaagtgaaataatgagtgtagaatcagtctcatgtgtgttgctgctagagatacagtcacaatgaccttctctcaatttctggaacatgtctagcatgttctcatttgtcaagccttactactttctagccttatacctgctattttcctttctgctatctttgtgtaaattactgtttctcaaacatcaaggctcaactcaaatgtcatctcctcagagaagcctttctttggtcactctaatgtagatacctttgttattctcgatcactatattttataagtcattcattgcaattatttttatttttacttgattttgtctttcccaatgttgggaatcagaaactgatacccccaaatatggtgctttgacaggtgctttgacatggtgaactgaagaagcctcaagttctctctgacctcctcccaggccccatctctcccagagcacagcatgaagttgttctctgacattcccttatctgcctaaagcctggacgcaccaaagaagaaaacaattagccctggtcccttccctgaattttcattgcctgaactcatactacaggaagacagaccgaagtccgtcagtgcacctggacagactttgtcacaggccagtgtctgttctgcaaacccacagattttgtgccaaaccattctatgttcttcaagcccattgaattttctgaaaaatcatttactgcccccaccccccgaaatcatccacatctccccatctccctttcccctaagaagggtgtatagccatctgtgtcccattgtggtggggtaattactctgtgatcctcttctgtgtacattaacatttgcatgccttttctcctaataatctgacagtgaagggaggtttttccttggcccctacaccctcaaaatgcaattttcatgaggctagagacactgtttatattgtttccattttattctagcaaccaaagtggaaacaagcacatggcaggaacccaataaatatttgttgaataaatgagtgaagtatttcctcacaattattctgaatcattggcattactggtagggagttgggctggggaatacaaagagatgtaaaatgctggagctgttctcatgtctgctttaaacttgggaggtttttttaaaaataaaattttaaaattttatattttgcttaaacattgatttgttgggttttgcttaagtattggtttaatttttggtattattggtctactgaggtataattaaccaataataaactgcttcatatataaagtgtataaactgacaaattttgacatatgtatgcagatatcatcactacaattaagatcatgaacataacaatcacaccctgtgaaaatttcccctgccacactctcttactccctctttcctgccctcccacgcagctaggaaaacattgctatgtttttctatcactaaagattaggtttcttttctgaaattgtatatgaatggaattattaagtatgtagttgtttggggcctgactttttaccctcaatataattactttttaatctatccatgttattgtatgtgtcaatagtttattcaggtttgttgctgagtaacatcctgattaatgaatataccacaatttgtttatccattcactgttgatgggcttttgggtaccagttgaaactacaacaaataaaactgctataaacattcatctacatgtttttgcatgagcatacttttatttacattgggtaaaaacctagcagtataatggctaagtcatatgggagacatatgtttaaatttttaagaaattgagaaatcgtcttccaagcagttgtaccagtttacattcctatcaacgtggtatgagaattccagttcttttacatttttgaaaacacttatcatggtcaactttttcaattagccattgaggtagaaatgtacaggtatctcattgtggctttaatttgtatctctctaatgattagtgatgttgaaaatattttatgtacttacttgccatctgtatactttctttggtgatgtgtctattccagcttttctccattttttggcattatttctctttttgttactgactgacttgtaaaagttcctgatatactatatctatgagtgttgtcagatatacgttgtgcaaatatgttttctcagcctgtggcttgcctttttatatttataacagtgtcttttgaaatgcaaaggttttaaattttaatgaagtcaaatatattgtttccaatttatatgtctttctatttgtgttatgtttaagaaatctttgccaaacccaagaaactaagatgtttccctgttttcttctggaaattatatagttttagctggcatatttagaactatagtacagttggtttatttgaagtaagtttttgtatatggtatagttttaattttgtacatgatgtaatgttaattttttacatggttaactgactgattgcaaatggctatttaattgttctagaagtagttgttgaaatgattacaatttttccattgattttctttagcatatgtatcaaaaaattgatcatatatgctcggctgtatttctgaactctattctgttctattcatccatttgtctttacatcaatgttacactgccttgattactatagttttcaatatgtcaaaagttagtagtgtaagttttactttgttttgttttcagcattgttagccttttaatttgcatatggattttataatcactctgttaatttctacaaataatcatgttaggatatggcgtgagatttaatcaaatcagtaataaatttggggagtagtaaaattgttgacaatattgattaatgtgatatgtgaacatttattcagatcttatttaatttctctgagcaagatttggaggcttacattgcacaagtctttcaaaatttttatcaaatttttccctatttacatttctgatactagtaaatggcatttcaccattaagtatagcattaactagcagttaatcacttttattggccttttcaaagaatcaatctttagtcttattgatttttctctatttttaatgttttattttttgttaatttatattcctttttcctattttaggtataatttgttcttcttttttagtttcttaagatgatactttgggtcatttatttgaaacttcttttcttttataacataagggtttagaactataaaattttctttaaatactggtttagtgtattccacaaattttgatatgttgctttttcatttttatccaaatcacaataaattctaattttttttgagatggagtcttgctctgttgcccagtgcagtggcaagatcatggctcattgcagcctcaaactcctgggctcaagtgatcttcccacctcaacctccaaagtgtcaaggactacaggcatgccaccatgctgtgctaattttctaaaaatgtagttggagtgatggggtctcaccatgttgtccagattggtctcaaacttctggacttaagcaatcttcctgccttggcctcctaaagtgctgagattacagatgcaaaccacggcctggccttaatatttctttgacccatgagatagtagaaatgataattttttggctccatgaatttggagattttgaaaatagcttgattggtttctaatttaatttaaatattgtctttgaacatattttgtattatctgaatcagatcaaatgtgctggagacttgtcctttattgagaatgtggtctgtcctagtgtacttcaaaataatgtatattctactgtttgttgggtagaattttctagtaatttcaaataggtcaattagttcaaattggttgatagcactgttcaatatgctttctaactttttgtctacttgttttataacttattaatagaaaggcatacacattttcaactataacagcacatttgtccatttcttctgtttggtcagtttttgtcatgaatgttgaagctctgtcactagatacataaatatttggtttgttctctcatcttactgaattgatctttcatcatcatccaataaccctttttatttcaggtagtgttcactgttctgaaatctatttcatctaatatcaatataggtcctcctgtttggtgtgggttaatgtgggactaatctgtttttcatccatttatcgttaagctttttgtatactggagatgtgtttaaaatagtatttctactttcagccaaggtatatttaccctttctaccacaaacaactagaaaactggacaaaacatatcaaacagttgtttccaacacagaacatcatgcagtgcagagcagtaactcctgaaatagtggaaacaagtgaagtgagttcttcaattaaagcagcttactgcatggagactgcttccaggcagcagtggagaagcagagaactaatgcagaactcaatggacacactctgagctgcagaaatggagttgaaagtgaaaggttgatgaacttgtggaaatagaattagaccattagaccagaaaaaaaaactaaaaaataagcagaatattattgaactctgggataactttaagtgacctaaaaaataggcaactgtagttcctgaaggagaacgaggagagtgagaacaaaacagaacaaattttaaagatataatgtctcattttttcaaaatttgaaggaaactagaaataaacagatctgaaaattcatatacatcccaagcacaagatacataaaaaaactacattaagccacattgaaatcaaatttctggaagcagctgataaagacactatgctaacagcagtcagaaaaagaaaagacacattacatactgaggagtaagataagaatggcagaagagttctcataagaaacaaagtgagccagaagacagcggaatagcatctccaaactacagaaagaataatctgtcaacctagtattcatagcggcaatatctttcactaatgaagacaaaataaagactcttcaagcataatcattcaagaagcatttatcaccaggagacctacccttgaggaaatgttaaagaaactcctacaggcagaagggaaaagattccatatgaaaatctagatcttcaccaaggaatggaaaaccatgcaaacaggaaattggtgtataaatatatgagggtttttttccctatttttaaagtctattaaaaatttgactatgtaaaacaaatataataacaatgtatatgctagtttataacacatgtagaaataaaatataaaaataatagcacaaaggatggaaaaggaagcataacattatcgtttgtttttaaaattatatccttgaaatggtataatattacctatagatagacttattacattataggtatgtcctataaactctaaaacagctactaaaaaggaatcattggtctaccaaagagataaaatgaaattataaaatcataattaatccaaaagaaggcagtaaacgagtaaaagtagattaataatatgtcacaaatagaaaaatagattgtaagatgatatattgtaacccaactgtgttaataatcatagcaaatgtaaatggtcaaagtacctctattataaagacagagactgtcagagcagattaaaaaacaaaacaagcaagattcaagtacagtaatgtgtcatttaataatagaggtacattttgagaaatgcatcactaagcaattaagtcatcgtgcaaacatcatagagtgtacactcatttcgcagtatccacaggagattggttccaggatttcccacagataccaaaatccatggattctcaaatcccttatattaaatgtcacaggattcatatataaactatgtatattcccctgtatactttaaattatctatagattacttataatacctaatacaatgtaaattctatgtaaatagttgttatattgtattttaaattgatattgtttttattgttgttttcatttagctttccaaatattttttatccgtgtttggttgaatctatggatgcagaacctacggatattacagggctggctctacttgcacaaacctaggtgatatagcctatgacatttctatatatgacaaggctatatggtatagccttttgctcctgggctacaaacttgtacagcatgttattctactgaatacagtaggcaatcgtaacacaaaggtgatcatttatgtatctaaatatagaaaaaggacagtaaaaatgcaggattataatcttatgagactgccattctatacatggtcagtcattgactgaaacattgttacgcagcacatgactgtgtatgctgcttatagctatgtagccaaggtattccttttacatctttaaatgtccaaacaaaattattaactgtagaaaaataaagcaccaaaaaacctagatttgaattgtgcaccttgctcaaaacaaaactaatgaattaaaactttgaggataagatttgagcacaattttgcaaaattagcttgaagtagtaggcatgggataaagaaagtttctaatccccacctacttctctatctctagctcattatttcttctgaatttaccctacagtcttgttaattcacactcaactcttcaattttccctttacctctctttaccattcctttgtgcctttgcatatactgttctatctgcctgaaaccccctttctacacttctgtatctaggtaagttgtgctcatttttcaagacttggttcaaatcttctctttgaagactttctgatttctccaagttatgtgattatatttacacttacataatgatacatggcttgaaacaaagcattctcttttaacccttgatacagcccctgagtcaggcattactttttttttttacgatgaaaaaaacttgggacgagaaattagatgaattgtaaaaaatcttatgtacaacatatgacagaatcaagacttgaatagcagccttatcactcattgtagtgtatcacggtaggttcacaataagggacaggatatatgttgtcacagtgttctttctcagtgaagtgcttatatattcaataagctaatggaaatactctctgagcttcttacaaggcttatggtaggtatgtaaacaatgcttgcttcagtctccattaaatcactttaaatgagatactgtgagtatacacaataatgctattcaaatgcttttgtgagcaaatgagattttctgcttaaattcttctatcatctttttcctattttcagaaagaaaatggggacaattgcaataatggaaatgcaagtgactggattagtcaatagcattgttgaactaagttaacaaacaccttagcttttcatgaacaatgatatagctaaactgattaacatagaatgatatcagaattagctcatcacattcatttttcttcttatcaggagtgacactgttgtagcagagcagttgttttctagctggtatctgtcatcatatataagattataactgtgacattgattttttcccattataatagagtggatgtaccctgcttaggtttgaatgtagggcattctatgaacctcagaaaaaaacagctggtaaggaaagggaggaacaaataggccagaactaagagatatacattggctacggaactggcttttccaaagattctgatgagcagagcaagtcacaaattccagttggcagacttaggtatgatttttcctgttgtagactttcaagaggaaatgatgagattgtagaagcatgtcaaaaaagattgtaggcaccgatgatgctcatcaagtaaatggcaacaccttcatttggttcacattcccattaaccactctgtgatggccaagtgtttggactggatgtaaacaggattctacccaacaattagaaacatggagagagtctccaatgtagatctgacaagcagttcatctctagatatataatagacttcaaattaagagcataacttcttgaagtttgagctcttcatgtttaaggtttggtcctaactgggtttaatggagcagaaactgctaaatgaaggacttaagtacttacttaataagtaagtatatagtagatatatatatatagagagagagagagtagatatactatatagttatatatagtatatatatacatatatacacacacatatatatatatgatatagtagagataggtagcaggcaataattggtcatgctatttaattatttatatttttggtgaaaagtaatgtaagttcttgtcctaagtaaagagagtctctgtgtagctttcatctttcaaaccaactgacaataaaaaagagaaagtgaaaaagaaaaaataaataagatttgtcataaactagaaaatagaaataatgctgaatcacaataaagaaaagcctaaaaatgctttgaaaattaaaactagacgtgggaaaacatgatcatgtttataaatatttcagaacaactcttcagagttgtccaaaagtatattttgcatcctgaggaggaaaataaattcctctctttgaactagtagatgatctactagttgtgtaagttgtgttgctagagccttcctaatctctgccctccacaatatcataacaagggagtggcagggccaaatgaggaaatgcacagaaaagccatagggcaggagtcagaatgtcattgtgacagtgccaattaaacctggatgggattcagtttacatcacgagaaggactcatgacaaatcaggttccactctgagcaaggccagaatacagacacgtcatggagcaggttatttcttataatgtgttctgaagcaacggactaacatcctagaggctggctgatccaccccacactcccaactacttcctgacactattcttcaaagattatctggtctggaaaaaaagtactcctatttaaaaatgagtaaccacagcaacaaacgctatgggagctacagaatcatctacatcagaattaagagggatgaaaaacagccaggagaaaaataattcaagccataaaagctatacagcaaagcaaatttaaattatgagttttacataagtgccactggaaatacaaaaaaaattgaaaagtctaatttcaatgtttcaagttcaaacaagatatgaaaaacaacaaaattataaagtgaaaaataagctgaaaggccttagtgaagaaatggaagagataaacactaacattgtgaaagcaaaagtcacatttaaaggaataaaatgaaaatcagtcactccttaaagcacagcaagggtgaataagatcagcttccgaaaactgagtggaatgaaattgaaaagacgtgcttaacacgtttgagaaaaagaatagatatagaagagaaaggaaagtcacatacaaatggtttaactccctgaaagggataaattgaacagaaaataatcagttacatgtatacagtaaacaagaataggggtgaaaccaaccaaaatatgtggtggaggccagggtcaggaatgggggagataaacagacattgtatagacaccatatcaatcagggaacaatcagagaagtagagtcgttgagccacatttattatattgattggaccttctacaattgtggaagctaagtcatgtatgtaagactgttgcttctgtgtttcttgctagaacctgaaatatccacagggaaggcagttgggaggaaagccaaacatgatgtaggaagcaggacaaagggggaacctctgagaatggattggagcctacactggcctctcaccacctccagtcctccggctttgataaggcaggggtggcctgcaggagaaactgattttcttcatctcagggctgagcacacacctggcccaggatttagaggagctgaaggagggaatgtggcacaaacttaaggagctaaacttcagcttctgtcccacagcaaaaaggtgagatggaaaagatgcaacagctcaggagagctacagtgtctaatgccctgcaccaaactactgtgtgtaaaaatatacgtatatatggctactgcttcactgtaaaatgtctgtggtgtcccatgctaaccagatactacgtagggcacagggatctggaaaatactgttccaggttggttaacgtgatacaatataaatccaccacaacctattggagtcctaattgccatatataaataggtatctttgaaagctgatgaatcaagaattccaagtatcaaaacattttttcaaaagttaaattttataaagatatccagatgaagttacaaaatgtaaagaaaatctttccaaacattaggaagaggaaaaactgttccttcttttctctctgtatttctttctctccgtctctgtctctcaaagacacacatacatgcacacacatgcacacacgcacacacacacacacacaaatctttaatcatggcaataaaatatattgggaagaggagagctataaaatcagatttgccagggttagattcctggctctcattctcattatttatgtgactttaggaaaattaatacatataaactcagtttatacactcctaaaatggtaataatagtaccttcttcaggatgagagagtaagttaatacatgcatgatgccagataactttggatcattctcctaaattgttggaaacttttgccaaaattactaagttgtgcaatttggggagtagcacagacaagccctacagcaactgggtgagacagtcattgctgaatctctgtagcaggaattattatgacgttggagcctttttactgaactctgtgtcagatgagctcccaacaatttccagatcatcaagaaaagtccagttttcaaaaagatatggcaagaaatctcacagtcaagaatctgagaattgtgctcaagccagtgtcataaatatttctcagaagtagaaaagcagagagaaagaatgtttccctccagaaccacgagatgatctcccgcttcctccgtggaaaatagtcctcttcaacctgtatttcattgctgagtttttgttttgattttgaagccacagattaatcatgcaattttggcagcaaatgaacgactagtatgctcaccacaacacaggacttgaatgtagcaagtacgtgagctagttgcagttaagttttaggctctagaaaatgcatttgaatctgaggagaaaaaaataagtatatatgtggctttaaattcaaccattccttggaagactttctacaatgttggcagcatttatgaaatagttatatttatttctttttggaatacatattttttctcttataaacaactatatataatgtaagggcaatcataatttaccatagaaagccacatcatgcaataaaccatctgagcactcttttggcctctgttataatttactgtattcaaagctgttggtgaattgtgtgggtggtaacgttatgagtttttcaatatctcactaagtatatttagaatgcttaattgaagcttaacctttattttgttcaatacatgttgtttctagctaatagttttgggggaaataatcccctaggtcaaagtcttatatttagctgcttctgttttcttttaaagctagaaaaatgaagggtgtgaatgaattgatataacaggaaatcaacagggtaaagaataattttgatgatttcttcttggcattgcaattatatccagtacacttgatgatgaaataaacaaatagttcaaacaaagccattaattttcttcctatctacacaattttaattagaaacatttaattagacttggctaaaatttctcaacaagattgcagaatgcatgcttatgctacttgtacaccaggaaatgtatttttcagcatttactaagtacaacaaatagctgccatgattgtaggtatttcatggaaaacattcttgtcaaaattatcttttatcccaaaaagctttcactggaaaacaaagttccctcagagtttattagttattaagctttgatattttaattgttataataaataagatgcctttttaatatattaactgcattttatattatgtcatttttatggcaagcaataaatgtgtttgatgttcttgatactatttcaccactgaattttttaaactttcattatcatgagcatttctgacatgaattaaaatgacatgcaaatctgtaagctcatttcactgaagcaaaaatgctaaattgttgaattcatagagccttttaatctttaggggcaaatattgttttcaactaaatttgatagaactcaaccaattgttttaagtagttctcttttatttctctcattctacaaccatttgtgtgtagaaaatatgcaaacacagttgtttttcaacttaaaaaataataaacattatttccactagcatgttaaattatttgaaggcactgtactaggctttctagttaaagaaacttatattacctaattacacccaagaggtaaggtccttatatgactcaccaaatatttactaataaattgttaaatatagttattttgagatgtctatgtttctaattgcatttaataataaataaaaatttaaatgttatctttaataatcacatatcagtactatattcttattctcagcatcttgggaaagacgtttaagtttaactagagtgacacttattttggcatttaagagtagagcttattaatatttaaatctatgcaattagatttcaatttttttcaaacgttttttgttattaggacacattcaaatttttaattttttctaaatttataaaagtatctacatggttgtttaaaatgtacttcagaaatctatagcaatgggaataaatcccatataattgccccaaaagatacaaaatgttaaatagtttgatgcatattttaacagatttttaccctacatatgtttaatttttcaataaaatagtgaaactacttgtacatattcacttgcaactggttctttctattcaataatgtattttaatcatgaatgaattcaatatataatggatttaaagaaaaaatacatggttagtctgaacgctgcctgagaattacatggttattctaaaactgaaaaagtcagctttgttctctttttttacttcttcaatttatcatcatagacacacagaggaagcaaatctcgattcactcctatggagtgagcatcacttttatcttcatgttacagctggggagtcagagacagaacattcaagcaatttgtccgatcccatactttcaggaagggaaggagccaggattcggaaagtggcagctatggtgtcgccagtccattttcctaagtactatgttccttaccacccacaggaaacaaccctccccacaataactgagctctgctacggtcactaacgaggtaaatgaataatatgcgcctacactgtaccccacccaccgacctgtttaagacacacaatacaacttcatgcctggaatcataaccatttacttcagtcccaaaacgtcagagatgctcgctaatgactgcccttcttaaagttaattctgtaaatgttaagtattatcatctcctaagcctttcccaaagtgtgtgttccatgaatagtctatggaaatgaaagagctgttatttactcaaaagttatttgtaggaagaggaggagaactcatgaaaatatacattgtgagcctctaaaaaaggcatcaaatatactgatcttcattttgtctgtaaaatattttataatatatcacttttctttttcagaatattcctaggtacaatggttccgggaaaaagattttgggaaaatgcttatctaatctgtaatcaccaaagaacataaatttagagtttgaatagaatagaatagaataaaatagatgcaagtcactgcttcatgctttttatatattttaacttgcgtagtctcagtttggcatttggaaagtgagaataatcataagtattccataacattttgtgaagataaaatagctaatatattatggcagatttatggagtaccacaaattcattggtactccttcattaagagatagaaactgtttagtctgggttagtctgtaactgcatttttcaatagactatggtagaaatgatgctatttcctgtaataagcctggcagcttttaacttggtctcatgaaaaaatcaagccatcatgtataaaatactgtgataccaccatgctgtgaggcagccccagacacgtggggaggctctggagcatgaaaaagcatgcaaagaaagaaatagagcagtcatgatatgccccagtgccagaccaataagtgaagaagacatcttggaagtggatatactccaggcccaaatgctataaatgaaactatctggattaaaattcaactatcctgagaagtgatgtcagcagaagttttaaagtatgaagctgggaaaacatactcctccataagagcaatgagtactaacaaaaattgtcaaaatcaaatctggaaattaaccaaaggcttacaacaatctggtagcagtcattcaagaaaaatggatgtttctgagtaataacaatgacttttgtggcattttactttgctgtattcctatcccccactctcccactccacagttcccttgcaaatgagcagccttggaattattgtagtcataaaaagcagaatcaagggacaactaagatacctgacaaaagaaagtttggaggccaggcgcagtagctcacgcctgtaatcccagccctttgggaggccgaggcaggaggatcacctaaggttgggagttcgagaccagcctgaccaacatgaagaaacccccgtctctactaaaaatacaaaaaattagccaggtgtggtggcgcatgcctgtaatcccagctactcaggaggctgaggcaggagaatcgcttgaacttgggaggcggaggttgcagtgagccaagatcgcgccattgcattccagcctgggtgacagagtgagaatctgtctcaaaaataaaataaaataaaataaaataaagaaacagcttggaaacacttctcctgccaagagaacccaaaaccttcacactttgaacagatcttttgaggggaaaacctgaaagttggtacagagaatacacagacactgtggataaagaaggaggaatctgggaactccagagtcaccaagcaccaggaccagctctcagtactgaacaggtcctaaggaaggggtgagtgaaggaactgcaggggaccacactcctgctaggacctctgcgatcctagctacaagagatccctagacctccacagacttttgaatttgcagggggaattgaccagagagcaggcagagatacagccagaaccttggcagagcccagaaagtttcctggcgtgcagtgcgactgcagcaaaaggcagccagagaccatctcccaaggctctccatcttgctctgagtgactccagtccctgctgactcctgggccaggagagagcacggctgcctctcccacaggtccagggtgcatccgatccacacaatcccttgtgcacaggccgctcccagactgactgcctggccgctcctacaggagaggcgcccacagcgcggcctcccctggcccgcctgagtgtttcacaggtaacctgggagcagtcaggcatgcccagcgcagcctgcacttgaccttgagaggacagagggcaaaactgcaggcctggtcccaattccccaagatttgagcacagtacccagaggtatggagctgagatctgcagcccgagctcaagttggggaggagccccactcatagaacatcaagcagagtgtcgcatgggttcatgtgtgctggtgcaggagctgggtgtccctccctccacaacatcagtctgggaaagacatagcctgttagccagccacaggcccctttcccagggagatccgtggcctggaacacctggaacagcccagtaatctgggcacagaggcttgagacaagtccagctggttgggcctgctcctggagtcaatgctggaagggggctcagtgaacagggtgcgagcagggcagtccccacagctgtctgcttggataacagccccggaccacaggtgccacaccagctgcacatttacaatacagccgccctgatcacgaggtcaggagattgagaccatcctggccaacacggtgaaaccccgtctctactaaaaatacaaaaaaattggccgggcatggtggcgggcgcctgtagtcccagctattcaggaggctgaggcaggagaatggtgtgaacctgggaaacggagcttgcagtgagccaagatcgcatcactgcactccagcctgggagacagagcgagactccatctcaaaagcaaagcaaagcaaaacaaaacaaaacaaaaccaaaaacaaaccaaaaaaaacccactacggctgccctgccaagggatcctccaaccttgacacatttcatcactagaccaccctcaaacataccctacaacacactctgactttgccaagctcagagaaccagcaggtccccagggacttgcaggtctcctggtgacctaaactttggctcagactgcccctctgggacatgagagcacagaccgccaaagccccacgtggacctaaggtaacatgagcagggcgccagcaattgcaggggctccaccaaagcctaggaacaaacttggtgagggactcttctctcatcctccatgtcccttctcccgagcactgctgggtatgcactgaaatacaaaagaagtatgtggctaagagcccacctactggccctactcttaagcactatctactggatcacagcatgaatgactacaccaaacaaaaattctttcagcacagttgaatgcctgtgaaacccaacatgggaaacaacccacaattaaggaaactttggagaaccttgaccctctgcaagcactcagatacaaagccaattgattacccacaatatacactgcagtcaaatcctcaaagtaaaaagaatatgaaaataaaaggtcccatctaaatagtagcaatttcaaaaagaaaagaaacaccagacccctcagatgaataggaattagtgcaagaacgctggcaactcagaaagtcagagtatttccttacttctgaaagattatagtagctccctagaaatggatagtaataagactgaaatgtctgaaatgacaaacacagaattcagaatttggatgtcaggaaagctcaacaagattcaaaacaaagttgaaatccaatccaaagaacatagaaaaatgagtgaagacttgaaagatgacataggcattttaagaaagaaccaaactaaacttctggaattgacaaattcggtacaggaatttcaaaacagagttggaagccctagcaacagactagaccaagctgaggcaagaatttcagaactggagaccagtccttaaaatcaacttagtcagacagaaataaagaaaaaggaatcttttaaaaaatgaacaaagtatccaagaaatataagattatgtaaagggaccaaacacatgactcattgacattcctgagggagaaggaagagagtaagcaaattggaaaacatatatgaggacataatccacaaaaatttccccaatctcaccggagagggtgacatgcaaattcaagaaacttagagaatccctgtgagatactatacaagaagacaatccctaagacacattcaccaaggtcaatgcaaatgaaaaactcttaaaggaagctagagaaaagggtcagatcatatatgaagggaataccaactggctaacagtgaacttcccagaagaaaccttacaatccagaagagactgtggacccattttcagcattcttaaagtaaagaaattccaaccaagaatttcatatcccatcaaactaagcttcataagtgaagaagtgatgaaatatttttccagagaagcaatcactagaggaatttgctaccactagatgagccttacagagatctttaagagagttctaaacatggaagcaaaataaagacacctgctaccacaaaaacacacatgggtatatagctcactgatactccaaagcaactacacaatcaagattacaaagcaaccaggtaccgacactgtgataggatgaaaacctcctacctcaatagtaaccttagatgtaaacagtctaaatacaccacttaaaaggcatggagtgacaagttggattaaaaacaaaaacaaaaaatacaagagccagccttctactgtcttcaagagacccatctcacatgtcacatgtagtgacacccataggctcaaagaattgatgaaaacagaaaacatgcaaacagaaaacaaaaacatacataggtcactattcttatatcaaataaaacagactgtaaatcaaccacattaaaaaaaatgacaaaaaggtcattacatattaataaagggttccattcaacaagaagacttaactatcctaaatgtgtacttacctaacattggaacacacagattcatagaagacgacttaggcagccatgcaataatagtaggagacttaaacacaccactgacagtattagatcattgaggcagaaaataaattttgaacttaaattagccacttcaccaatggacctaacagacatctatagaatacttcacccaaaaaacacagaatatacatttttctcatctgcacatggagtgtatattaagatcaaccacatgctgggtcataaagcaagtcttgataagttttagaaaaatcaaaatcatactaagcacattctcatactaagcacagtggaataaaaatagaaatcaatgccaagaagatttctcaaaaccacccaattacatggaaactaaacaacttcctcctgaatgacttttgttaaacaacaaaattaaggcagaaatttaaaaaaaatccttttaaataaatgaaaatggagataaaacataccaacatctctgagatgcagcaatagtagtgttaagaggaaagtttatagtgctaactgcctacatcgagaagttagaaagattgcaaattaacagtcaaacatcacacctataaaaactagaaaaaaacactatttctatcaaactatcaacatcatctttcacagaattagaaaaaaaaagtattctaaaattcatatggaacaaaaaagagctcaaacaagcaaggtgatcctatggaaaaaaaaaaagaaaaaaagctggagacatcatattacctgacttcaaactgttctacagggctgcaataacggaaacagcataatgctggtacaaaaacagacaggtagtgttgcaggaagtcagggatcccgaatggagggactggctggagccacagcagaggaacataaattttgaagatttcattttaatgtggacatttatcagttcccaaataatacttttataatttcttatgcctgtctttacttcactctcttaatcctgttatcttcgtaaggtgaagacgttatgtcacctcaggaccactgagagacttgtgttaactgtataaactgattgtaaaatgtgtctttgaacactatgaaatcagtgcaccttgaaaaagaacagaataacagagatttttatggaacaagggaagacaaccataaggtctgactgcctgcggggtcgggcaaaaagtgtggggtcgggcaaaaagagccatattttttcttcttgcagagagcctataaacagacgtgcaagtagaagagatgttgctaaattcttttcctagcaaggaatattaatattaataccctgggaaaggaatgcattcctggggggaggtctaaaaacagctgctctgagaatgtctgtcttctgcagttgagataaggactgagatatgccctggtctcctgcagaattctcaggcttactatggtggggaaaaattctgcccggtaagtttgtggtcagactggttctctgctcataaaccctgttttctattgtgtaagatgtttatcaagacaatacatgcactgctgaacaaagacccttatcagtggttctgctttttccctttatcctgttccctcagaagcatatgatctttgttagacccttattagtagttctgctttttgccctttgaagcatgtgatctttgtacctataagtacaatataggtacaatccctgttgtacctataagtacaatatacgtacagtataatccctgttcttatacctcctccccttttgaaacccttaataaaaacttgctggtttgaggcgcaggcaggcatcatggtcctactgatatgtgatgtcacccccagtggcccagctgtaaaattcctctctttatactgtctctctttatttctcagccggccgacacttatggaaaatagaaagaacctatgttaaaatactaggggcggattttccccaataacattgaccaatggaacagaatagacaacccagaaatagagtcacactcttacaaccaattgatctttgacaaagtcaacacaaataagcaatggggaaagactccctattcaataaatagtgtggcaaacactggctatcctatgcagaagcatgaaacttgacgcctacctatcatcatatacaaaaatttactcaagatggattaaagacttaaatttaatacctgaaactataaaaaatcctagaagaaaatctaggaaacaccactctggacattagttttcggaaggaatttataactaagtcctcaaaagcaattgcaacaaaaacaaaaattgacaagtgggactaaagagcttctgcacagcaaaagagacaatctatgaacagaaactataaacaatctatagaatgggagaaaatatttacaaactgtccatctgacagatatctaacatggagaatttataaggaatttaaacaaatcaacaagcaaaaaggaaataatcccattaaaaagtgagcaaacttagaagataggtagtgatatataaaatttctttaaaaaaaaaaaaagggagcagaggacctaaagagacacatatcaaaagaagacacaagcagccaacaaatgctgaaaaaaatgctgaacatcactaatcatcagagaaatgaaaatcaaagccacaatgagatatcatctcacaccagtcagaatgactatgattaaaaagtcaaaaaacaacagatgctgttgactttggaaagaaaaggtaatgcttatacactgttggtaggaatgtaaattagttcagccactgcaaaaagcagtttaaaagattcctcagagaactaaaaatagaacaccgtaacccaacaatcccattactgtatatatatatacactatataatccacacaggtggagtggataaagaaaatgtcgtacatatacaccatggaatactatgtagccataaaaaaagaatgaaatcatgtcattcgcagcaatgtgggtgcagctgaaggccatgccaaataccatatgtcctcacttataagtaggaactaaacattggggacacatggacataaacaagggaacaatagacactggttaatacaagagcagggagggagacagcagtgcaagggttgagaggctacttattgggtactatgcttgctatctgggtgatgggttcatttatacatcaaacctcaacattatattaaatacccctgtaacaaaccttcacatgtacccctggaacctaaaataaaagttgaaattagaaaaaaattgagaattatatcaaccactaggataaataatttggagttctcccaaagccctactctccaaaaaaattgtcatgatttgacctgttttgcagttccctggaaaacaccactcagtgtttgtcttttttgatctatttcaaaacttactgactgcagacaccttttcttggggggcatttataaaaacagtcaatggcattgcagttgtctgaagtgctaataacagttgagcaatcaaaaagcttaccaaaatctgaaaagaaaaaaattggtgaacaagatgcccatagaagtctatgaaaagctacaaaataactgggaatctagtaggccattctgcatatgtgtaggactgtccatatccctgggaaagacctgagaagtcctaatctcatacctctagctgaccttgaggctttgtgcaaagaagaggtaaaagctgaagcagaattataaactggctcctttatccttgaaggcatgcccaaatgagacaaagtccctggaaaataatggtagatttattggttccatgcatttaagaaaatctctgtccaatcactaggtgaccactaagctaactgagcagagatttcagaggctccacatgataaagagtatagaattagtttaggaagtcactaaacagaccaaaagtatgaaaaataagcaacaacaacaacaacaaatagtaataaggggcagattctgattttgaaatctggcacattgtattatttatgatatccaggttttattaaaaaatatgagacatgcaaggaaacaagaaagtgcgattgatatacaaaaacaacaacaacaaaaacgcaatcaaagaaagtgtcacggatgagctcagctactgggcttattacaaagactttaaatttgctattttaaatattcacaaagaactaaaataaagcaagccatgtctaaagagtcagaagaaagtatgagaatgattctcaccaaacagataatgtgaataaggagataggaattttgtttttaagaaaataatcaaataaaaattctggagttgaaaagtatattaattgaaataaaaattcaataatagggactcatcagggaattttttttctgccataagaaacaatagcaaatttgaacagaggttaattttattatctagtctattaaaaaaataaatgaagaaacatgaataagacctgaaagacttctgggacaaaaatctggcaaacaaacgaacataggcataatggaattcacagaagagggaaagggaaaggagcagaaaacatatttgaaggaataatatctaaaaatgtttcaaattgatgaaaaaaattaatctacacaactaggagctcattatttcctaggaagataaacccaaaaagatcaatggccaaccacacaataattaatctgtccaaagtcatagataaagaaaattttgaaagcagcaagagagaagtgaccttattctgcacatggcattctcaataagattaactgtttatttctcttcagaaccatggaggccagaagacagtggtatgacatggtcaaatgcatgatcaaagaactctatatctagaaaaattgtctttcaaaattaatggaaaaattaaggcattctcagacacacaaaaagactttacggatagaagaccctccctacaataaatataataaggggactccttcaggctgaaatgaaaagactttagatagttacttgaatccaaatgaaaaagaagatcaccagtaaatgtaactatatagataagcataaagaacagtataaatttatatttatttgaaatattttttatcctgtttatttagaagataactttataaagcaataaatataaaactatgctgatgagattacagtgtatcaaatataatttgtatgacaaaatagcacaaggaaggtggaatggaattattgatggccgttgagaaacctctgttcttgtctccttgtttgaaataatttaaacaagagtcacacagcaaaggagatgcagcatagaacagtttagtgcaaaggtgaaataatactctgaaagactggttgagaatagacaaagagatgatttgaattggactgcttgtgaggatgagacagtgttgactgttactggggaaactccctttatgggactcttatatgattattcataagtggattagaagaggttttactaataagcatgttctgggtggtcctctgggtacacatgtgcagtagctgtacatgcttgttcatacatcatatgtctcattagcaccttaaatctccacatagggttctgatttttactattatagtgagtgaagagtcagtccgaggacaggtaaaatcaaaatatgcatgctctctacaggggaaattccctactgtagatagttgtgcttgaatgagtcagtttgactataaggtgaatgctgcagtttattgtattgatggtgcagtcaccatagttgccacatagcgaggacatgtttacttccttgactacttatcctgcctcagaatgaagctgtataggaataaagattttataccattgaagtcaacttggtactaatccaaacaagaagtatataaatcgagatgttaattttaattttcagggcaaccactaacaaaataactcaaatatagtgaaagaaaaaataagggtatttaaattatacatgagaaaatatatctaattaacacaaaagaaaaaagtgatagaaaaatggaggggaaaaagatacaagacatagagaaaataagtagaaaaatggaagatataaatcttttcagtaattatattaaatgtaactggattaaacactccaattcaaaggcagattggcaaaatgaaaaaaaaactagaaagaacgagccacctatgtgttatctataagataaatattttagattagagacacaaataagctgaagttaaaagatacataaagatatgtcatgcaaatagtaccccagaaaaagctggagtagttatattgctatcaggcaaaatattaagtttgtgacataactatgtattactttatgacaaaaatattactataagcaaagaaggacattttataataataaaaaggttagtcttttaagaagaaataacaaatttaaataactgagattatgcaaagtatgtattctaaccacaatagaataaaattttaaatcaataacaaaagaaaatttggaaaattacaattagtttgaacttaaactataagcttctaaataaccaatacatcaaaggaaaaatcataaagaaaatacaaagtacttaaagatgaataaaaatacaaccaaaacttatgggatacagctaaagcagtgcttaagaggaaatttatagctgtaaatgcctgtatttaaaaaattaaaagtcttaaatcaataatctaaatttccaccttaagaaactacaaaaaaaaaaagagaaactaaatccaaagttagcagaaagaataaaataacaagaactacagtggaaataaataaaatacagtacaaaaaagagagggaagaaaaacaaaagttgattgaaataatcaaaaaaattgacaaacttttagctagactgattaagaaaaaaaagagaggacttaaactaacaaaataaggaatgaaaaaaatgtacattatcactgcccttacagaaataaatattttacaaaggaataccatgaacacctctatggcaacaaattagataacctcgatggaatgaacgaattcctaggaagacacaaactaatgaggcatatacaaaagaaataaaaaatccaaagagatctataacaagtaaaaaaaaaattaaaaattaacaaagaagaaatcccacaaagaaaaacacaggaccagatggcatcactgattaattctaccaaatgattaaagaattatcatcaatccttcacacactgttccacaaagtagaagaggaagaactagttcccacatcattccatgaagctagtattctctgccaccaaaatcagataaagacatcacaagaaaaaaaatagaacatagaccatattccttatgaattgagatgtaaaaatcctcaaaaataaaatgaacttgaactgcccatgggaggctttcctaaaatcttgacccacaatatcatgaacacaacattttttatgccattatatttagggctattgtaaaatagcagcaaataactacatgtgtatgtatgtgtgtattatatataactatactaaattattatgtattatacatgtaacaattatagaagattggacaaatctagtaacatctaattaatattcaatttattacaaatctaataatagctaatttgttgtttttatttaacagtaatgggagttgagaccaaaaaatatgggagttgttgaaagtcatttaatccctacatggtcaagtctgaatttgaacccaaatatcctagacagtacttctctggaagctggtattaggtagatattgaaccaattcttcatttgtctcagatctcagaaaatgtaaaactattagaaaaggatatgaatattgtacataaaataaggggaagacatttctttttcttcattttataatctagaaataaaacctacataggaaatttatatgcatgtttgtatgtttgtgttaatgtgtatgaacatatattttattttcaaggaagaaattattttctaaataaggaccaatctctaatccttaaagtatccatcagaatgtgattcaataggttttgcaaaatcctagttcagatgcaacttaatcactagtcattatttcggtgtgggccatacttagaactaaagtgctcagaattcttagtcaacaagataagtccttgacagatcgtaacggacttgtctattttattttatttttttaaaaacccagtgttgaaaagagaaacttggttagaatttccatgattttttataatggataatttggaagaaaaggaaagaaaaggctgtgaataaggaagattaagttattcttttatgcatccatccattccttcatttacaaaatatttattgaacatctattatttgtcaggcatgctggagacaggcagtaaacaagacagccaagttctctatccttattttattgcgggagagagaaccaataaaagataatgaggagacaggatgaaagaaggaaactagccaagttactactaagtagcacaactgagagatatctgtattatctgtctgatcttatgatggcatcagtagagatggaaggatgcgaatgagtatgagaaatgcttgtaggctgaaaacaagtagtataatttgcgtattatgtttatttgtgttatttcatattgttttgtgtttcatatcagtgatgttacttaaaatatgcttaaccacatatctctattaaagccaaatattatttgctcttcatcattgtatattttttaagtattttagtgataacacattttaataagtttattaaatcattttcaaagatcgtctcaaatgtgaacttaatggaacttactttgtagattattaactttccaagtcacagaaaacaaaatggagagaaaagaatctcagattttttaagttgctagatacagagaactttggttctgtctttctgtcctaaatacaagtggctgaacatttttaaacttaatgcctaataatggaaatgaaagtgataccactggcattggtggttgtttgtatttctgctaggtgataagtcacttgaatgaaatgaccaaatcaagtttgtggtatggacacagataataacacccatggtatcaaagatgagtacctaaaagagattggaaaaattactgagaggctgaatttatattttttaaatgatatgcatataataaattaaaatgtcaatattttaaaatagagtcacaaatattttatttatttatttttattgttatcatttttttcctctgaaatccttgccctctattgggcaaggggtgagggaagcagacagaccggttggacatagtagacaggtatgtgaggacaaaatgctactcaaaagctagccaacccatactcccctgaaatggacgctaatgcccttcaaactctgggcattggtttcacacacatcgtcttccagggataaaagaaggggttcttgtaaagcttcttgttaccctcaaccatggaggcaagttccgagttctggttttcctaggacactaactctagtgtccctgttgcatcagtgcctgtgtatggcctcccagcccaaccagaaattgacagaaaggcatgtatttggtgaaaagatatacatatatttagaattagccagctggactcagtttagatgatcccaattttgtttgcaacatccaaagcatcataatcaggagccagttgaacatatgccttcttctctccatcaggtcgaatcagggtgttgaccttggccacatcaatgtcatagagcttcttcacagcctgtttgatctggtgcttgttggctttaacatccacagtgaacacaagtgtgttgttgtcttctatcttctttatggccaactcagtgatcagaggaaacttcatgatagcatagtggtcaaacttgtttctcctgtgagcgctcttccaaggatatttgaacggcctccagagtcccagtgtcttgggcctccagaaggtgagtgacgtgtggatcttctttttttttgtggctgtggacacctttcaacaccgctttcttggcatttaaagccttcccttgggcttcagctttaggaggggcaggaacttccttcttcgcttttggcaccatcttgtgaaaaggatatttgtttattttaaataattagtttctctctttgcacctcttgagattatcagagaatggaaataagatgagataaatttaaatgataaaactaacattttaaagtatattttgattgttgcatccagcttgtaagtattgaagagctgtaagttatctagttctacacaaagctcagtgaataaaaagcataaggcaaagcacaacttttcaatctatcagaaaaaaaaatattcaaaatgccatgtgcaaagtgtatgctcaattaaaggtgttgaaaccatcaaggctcatgcaagctttttcttagcttctgtaataccaaataagccctgctatatgtcttgatttaccatgaaagttaagtgtcacattttaggcaaataaaagttattaaaatttgacagctggcaaattatgctaacatctggtaacaaatcattcttgacagttcaatagtacacttcttattgcatagctattaatattataaacagcaaaatgcaaaaatcatagcacccaactaacatattccctggagtgatagaaagaatgcactgtttatcttaatgtgtaagaaatgtcatcttttcacgtctgaggtttgaagtagattggaactgaataactataaacatgggtggcaccatgcagtgccacaagctaaaaagagatttgaaaatttctgaatttggagtgacatgatgatacatttacagtatgtggggggagtagaaaaagtagtaagaatagattgtaaccaataataataacaataaaatgacattacatgcttattcatcactcatctggtataatatcactttcttggttaagttggctaatagttatatataacagaatttctaactggtgctttaacaaaatcaagttctagaatctagtaagtggttaattcctatctggctcaaatacctggcattgggatatggatgttccttgctgtcacccaacttcttaaaggagggaaaggaattttactttcaccttttattttgatagtggtggtttctacccataagtcactctcattcacttataagtgttacaaaaaaaaggaatataatacataaaaatataatcttaaccaaaacttaaattgtgtttacaaaataaaagctgaattgggatgtgggcatctggattgtggctctggcttggtggtgtaaaaatttctgtccctccatgagtgcaattttttcaaattttttttctttttaacttttattttaagatcaggggcacatgtggagtcttcttatataggtaagctcatctcacaagggtttattgtacagatgattttgtcacccaggtattaagcctgctatccattacttagttttcttgatcctttccctcctcctgtgctctaccctacagtaggccccagggtctattgttccactccacgtgcccatgtgttctcatcatttagctcccacttataagtgagaacatgcagttatttggttttctgttcctctgttagtttgctcaggttaatggcctctagctccattcatgttcctgcaaaggatatgatttcattccctttatggctgtatagtatttcatggtgtatatatgccaccttttctttattcagtccaccattgatggggcgtataggttgatttcatgtctttgctattatgaatagtgctgctgcaaacatatgcatgcatgtgtctttatgacagaatgatttctattccttgggtatatacccaataaagggattgctgggtcaaatggtatttctgttttggggcctttgaggaattgccacactgttttccagatggttgaactaatttacactcccaccaacagtgtataagcctttatttttctccacagcctcaccagcacctgttagttttttacttttttataattgccattctgattggtgtgagatggtatctcattgtggttttgatttgcatttctctaatgatcagtgatgtagagctttgttttcgtatgtgttttggctgcatgtgtgtcttcttttgaaaagtgtctgttcatgtcctttgcccactttttaatagggttatttgtttttttcttgtaaatctgtttaaatttcttatgatgctagatttcagacctttatcagatgcatagtttggaaatattttgtcccattctgtaggttgtctgtttattctgtcagtagtttattttactgtgcagaagctctttagtttaactagatcccatttgtcaatgtttgcttttgttatgattgcatttgctgccttcatcatgaaatctttgcccatacctatctccagaatgtttttattgcctaggttgtcttgcagggtttttatagttttgggttctacatttaagtgtttaatccattttgagttgatttttgtatatgatgcaattttcttactgtaaaattagaagatttaaagaatataaattctatagtcatttctaactatggaatgcatgtgctcttaacttagatcaaactccaattgaatttagaaaatttagtcaaccaggaactaattgattaaacttgctgaatattaaatgtagagaattttactcactcatacttttgtgtgtatcaatcactaagaccatataattaagcaaaagcaatggtagctctattttttaatatacattcaatttttaaagaaaaatacagtaccgaatacaatatgaattagcatatgcattttataccttgatgagagaccccaggtataaaataacacttctaaaatggtatcttaaaaaactgttttatatatagatatattttaggaagctcctgtgttttgtttcttggttggctataagactgcagagttgaacattctaaaaataatcaatgactgagaattcatttgctttaccacatttatagataatttatggatggtttttcacttctctaacactcaagcctcaattcattttcaaatacatgaagtgtcattttaagtatacagtgggctcttaatgaaatttgctgtcttaacttttaaatgtttcagagatttttattttaagcttggtaaaaaaaaatcagagtaaccttcatatgttttttatattctataagctgcaattaaagcacgtgatttttaaaaaagaatttaaatttcaaaccatattgctttattacagcaacagaaacttatgtcctaaatcaaatgccctataaaaatattgtattttcactttttgcaattttaacaaaagctgtccatttgagttaaaatgtcattttattagtagtttttcattatgtatacttgtcattatttttcctttttcccttttttttttggaaaatttaagatttgcagaagagaaattacaggaaactatactcttttgttgttgcagttgaatactagattaatagaatagtgaatcctcaaagttgacgactgcatacttaaacatctgactgtagggtcggtaaattcagtcttattttacaataaagtttatttagattgactgtttatgcagaatagcatcctactttctctaagttttcttctttgactgaggaggttactaaattaagctgctcacttgtgaggaagatctgctggttcaattgccagaccaatgggcagactgctgaagcagagaaacctcattgttttaaagaggttagcaaacctaatggaaacttggttactgccatattctcacagacttgagattttctcttgcttccttctggtatccacctttgcttccggcctgatacttttagagaatttgggaaagagaatcaccgaggagcaggggctccattgccactactatttcaatagtgcaggtggtgtgctatagaaacttggaggacgggttatgttattagcccccatttttatccctttgttataggatcttggaggggtcgcctttccagccagaaagctctgtggccagtggtgcctttgcccgagttttgcttgagcctactgggctcattctgcctactcagcctggcaggctgtgctcagctcaggctaccagcctggatcccacgcctccaagggagactgagtcaggcgtggagtggcgagagatgtgtgagcaagcatcgggtctggccacactgtgcagtcagacacaccagctgctgccacagggtgggcagctctaggtgctggcatgggcgccagctggaccaggcacatagcaagcagtttctccagctggcaccagggaatgtggtggtgcctggaagcttggagatgccagaaaccgcagggctccaaagaggtcgtcacagtcctggcttggggaggtcccaggtctgggctcccctaagggctgcagctcttctctccttctcttccccctcaacatggagagcaagaggcatgttgcagccctgtttgtgttacagcaattttcgcctcgccattcggcaggtcctgaatttttgtcctgcaaccaggaaggatgagttctgcagacaagcgaaaggtcagcaagatgaagaggagctttattgagctatagaacaactcagtctctcgcaggtggcagctcctttccacagccagggtgtcccctccagtgttcggcccccagcagagagggtggctgccctctgcagccagtcctcccaacgcctgcagctcttagcacagaggagcccctggagtgtgtagctccattctgcagctggttgtcccgacgtctgctcagctccgggtgagctgaggcttttgctgtgcagaagctctttagtttaactagatcccatttgtcaatttttgtttttgttacgattgctttcgctgtcttcctccccttcccgggaggaagtgtgtgccgactggtccatgagcagccatgggcgggcccagaaaaggcaccacaagttcccattccagtccgggtgactggcagcctgcaccccagccttcaggccctccatggtcggaaggtggagcctcgctcaggacccacctccttccacccaggaatccgtctgcttcctgctgcctttcatggcaccgaggctgtaggtgccaaagggcggccaaggggctcagctttatgggacaggctagagcaatgtagtgaggaacagagatgtaatcgttgagggtttagcaattttaaatagggcaatagtgacagacctcaatgacaagagggtgtcagggtggaaaatcagaagtgaggagacttctggtttcagttctgacatgtaaaggacttggaagtcattactctcatccttacaacaagaaaaaggctgaatgaactgaaaatcagtgacttttcttggatccatcagataagtaaggttaaagggaaacctgccaccctgaagtatggagagaattgtgaatctagagagttacagaagaggcctactcacctggagtagctgttgctagagacgtacattaacatcaaccaaacaaatggtcattttgtcagattgctggaggctgagtgtgaactaaaaggcttatggtgttgtgtctaagaacaaaccaacaaagcaaggtcacctagattttctcccatgttatcttctaggaattttatagttttgcattttgcacttaagtctctgtctagaatctttttattttcatatggacgtccaaatcttacaatacctagttttggaaactattctcttttctccattgaattattgcctttgtttctttgccatagattagttgactctatttgtttaggtctatatctgggccactctattctgttgtcttgatctattttttctattcctccactaacattatgctgtcttgattactgtagatatatggtaagcctggaagtcagatagtgtcagtcttcttttttgttcttcttcagttttgtgttgacaattccaggaggtttttcagttgttgattcttttagattttatacttacacaaccatgtcatctgtggacaaagacagatgatttatttctttcccatatatatttatataccttaattttcttttcttattttaccagttatgacatttggtacaatgctgataggcgcggtaagagagaatgtgcttgccttgttcttattcttagtaggaaagcatactgtttcccaccatgaagtataatgtttgctgtgggttttacatagatactttctgtcaaaataaggaagttccccattatcctagcttgctgagaatttttatcatgagtgagtgttagattttattaaatgctatttcagcatctgttggtatggctatatgattttccttttagtctgttgatgtgatgggttacattgattttcaaatgttgaaacaacttttcctatctgggataaatctttactgattggggtgtttttttttaatacatgattggattcatttttctaatacttgtggaggatttttgcacctatttttgtgagagatattggtctgtagttttccattcttgtaatgtctaattggctttaatatggagtaatactgacctgataaaatgagttagtaagttttgcctatgtttctatttttttggaaaatattgtagacaatcactatgatttcttccttaggtattataattcactagtgaagccatctgggcttggtgcctcactattattatttagaaggttattaaatattaattcaatatctcaaggcctattaacattatctatttctcctcgtgtgagttttgtagtttgtgtctttctagaaattcatccattttatccaagttatcaaatttgtgtgtaggaagttgttcataatactcctttattattcttttaatgtccatggaattagcagttttgcccctattttattttggctatgagtaattttgtcttctctcttttcttgttttgttagacttgctagaggtttatcagttttattgatcttttcaaaaacacagtttgtagcttattgattttctctattgttttcctgttttaaacttcaatgatgtctgctatagcttttatctcttttttttttctggttgcttcaagtttatacttgccttctttctccaatttcctaagatgaagtttagattacagatgtatatatcttttttctaacacatggattcagtgctatattcttctaaatacttttgctgcattacacaaaatagggaattataacttgcattacttttatttagttcaaaatatctttgatttctcttgagacttttttgccccacgtattctttacgagcatgttgtataatctccaaacaattcactattttctatctttcattaataatttctagtttaattgctattgatttctagcatattttgtatgatttttattctttcagatttgttcagggtgtgttttatggatcagaatgtggcccaccctggtgcatgctccttgtgagcattttgttgttggatggagtattctataactgtcagttagattaagttgatcaaaagtattcttcaggtcagctctattctaacttttgttctgtgaaagacatcgttaacaatgaatgaaaaggcaagccacagactgtgtgaaaatatttgcaaaacatatattttataaagaatttgcatctaaaatatacaaagaacttttcatatataacaattttaaaaatctacttaaaacataggcaaagatccaaacagacactttaccaaagaaaatacacagatggaaaatgaacatatgaaaatatgtttaacacgattgccattaagaaaatgcaaattaaagtaataatgaggtactagtccatacgtattaaaatagctaaaaaaaaattcatgacaataccagtttctggtgaaaatgttgagcaagaggacctcttgttcattgctggtgggaatgtaaaatagtgtgactgctttggaagacagtttggtagcttttacgattaacatagtctgaacacatgattgaacaattattttcctggatatttcccaaattgacttgaaaaatatctgcagatataattatagtagctttattcataacaccaaaagctgcaatcaacccaaatgccattcaatatatgaatggataaacaaactgtggtacatccatacaatgaaacattacttaatgattgaaaagaaatgacctgtcaagccatgagaaggctaagacatctttaatacatttttgtaatgaaagaagaaagtttgtaaaagttacatgctgtgtaattccaatgatgtaacatcctgaaaaaggcaagactatacagataattaaaagataaatacatgcctaaaaggtggagagggagagaggagtaaatatatgaatcacaggcaatgttttagggtggtgaaactattctgtatgataatataattgtgaatatatgcatttgtcatactcattgaaatttacagtacaaagagtgaacatatcttaatgtgtgcaatttttaagaaaatcatttaaaagggtgagaaaatcccaggacagcatgcaaaatgtaataaaataaaactggattactaacatatgaaacaacatcttatatcaatgatattgatacagttggatttatatctgccattttatgttttgttttctgtacatttcctaattttttgtccctctattcctactataatcctttcttttgcattaagtgaatgctttctaaactagcattttaactccttgcataattttttactattttttgagagtttttaaaaaatgatggctttttgatttaccatacacaacttatcacaatcagctccacttttatgctagcatgtttccgggggcatatagagataccacttgtagctctagctctattccctttcttcattttttgtgttattgttatacgttttacatctattaatgctatgaatccaacaacaaacacgttataattattattttgttttattttctttttatctttttaaaagttttagattcagggggtacctgtgcaggtttgttatatgggtatattatgtgatgttgaggtttggggtacagaaggccctgtcacccaggtggtgagcatagtacccaataggtagtttttcggctcatgcttccacaccccctagtagtcgccagtgtctactgttcccacctctatgtccacgtgtattcaatacttagctctcacttattagggagaacatgcagtctttggttttctgttcctttgttaatttgcttaggataataataattattatgttaaaatctgtagtcattttttaggccagtatagttttgcttccatccacctactttgtactattattaaatatttgcaaatatattctacttctgtatgttatgcccaataatgaattgtatacatactgcttgatgcaattactttttaaatcacttagaaaagaaagcataaatatgcattggtaccatcttttataattacataattacatgtaatagtactctttgtttcttcttgtggatttgaattaccatctggggtcacttactttcagcctgaagaccttcctttagtatttcctgtaaggctagtcaagcataggcttgatatgatgtgatgaaaatggcactttacctcagtgggtcttcccctcagaaagtcgtaacacaaatcaaatcataagaaaatgtcagataaatcccaacagaggtacattatacaaaatataaaaatttttaaattgccaaggtcattaaaaacacgtaatgtcctgagaattgtcatagccaagaggagcaggagtggacatggtgactaaatgtgatgtgatattctggatgaaaccctgaaaacgaaaagggcacttaagtaaaaactaaagaaatatggacaaagtatgggctttagctaattatactatatcattactggttcattcattatgaccaacataccatactcatgttaagatgttaatgataggagaaaatgaatgtcgggtagatgggaacactctgtactattgtcacaatttgactacaaattttaaactattcttcaatataaattttatttttaaaagacaaataaattagagattcttcagtagggcagctctctcaggataagacattcctaggtgacagatcagctggtgctaagatggaaaagtgtctggggtgtctggggcacaacgaagaaaccagtgtgatgggagtggcatgaacatgagggaaagttgtattggaagttagagaggtaacagaggacaggaagaaacgtcttttcatgtttagaggccacttcaaggacttagatttcatcgtaactgaaataaagaatcatatgtgggttttgaaagggttactggcaggctcatttgaaataaactgcaaagaggggaagaatgcaagggtggaagcagagatactgattgggagtcttacagtaatctggaaggagttggttggtagcagtgagaacaatgagaaacgcctgactctggatatattttgaatatagaggcagtaggatattctgactagctgtggggtgtgagagaaagagacatatcaagaatgagtataaaattttgggggtatctgcaaggttagaattgccattagctgtgatccaactggagaaggtttgggagaaaggtgggaggctcagatttgagcttgtttggcttgagatgtgtatttaatgtctaagtaataggtatcaggaaacagaggggcaaagaaacctggaattcagcagtgagatccaggttatagttataaatttctaagtagttaacatgtagatagtgtctaatgccattagattggatgaggtgacaaagggaacaaataaggaagtccaagaagtgctctcttagaacatacactattaggagttcaggaaaaagagaaagagattcagaaagagctgtcaatgaggtaggaaaaggaggaggaggggaggaggaggaggagctggagggaggtaagaagaaagagaagaaagaaagagaaaaaaatatttccaggaagagagatgtctgctgcagcaaatgctaccacgggataaataagaggactaagggttgactttgagttcagtaatatgaaagtcacagcttggggagggggtggtggagtacacacctcactgatcacagagaatataaaacatttcaaatagctttactgaatataggagcaaataaaatgtcaggaactagaacaaggaaagtgtagtaaagatagtttcacctagatgaaaaggattgttatcgcctacacaagtaaaggactggtcttgggtaggagtgtggacaatgcacctataataagaaatgtgaaagcaaaccaggttggtactggtgctgctggggtcagtggatgtgatggtgagagtctatgtaagatctcggtcaatggttttcattttctaccactgtattattaacacattattatttcctccctaatttatttgagcatcaaaacaatgttgtaaaatcacatatatatataaaaaataaatatatatatacatatatacatatatatacatatataaatatatatatgtgtatatatatatatatatatatatagagagagagagagagagagagagagagagagagagagactgattcttgctctcttgcccaggctggagtgcagtggcacaatctcggttccctgcaatctgtgcctcccaggctcaagcaattctcatgtctcagcctcccatgtaactgggattacaggcatgcaccaccatgcccacctaatattttgtgtgtgtgtgtgtgtgtgtgtgtgtgtgtatttttttgaagagatgaggtttcactacgttggccagtctagtctcgaattcctgacctcaagcaactcacctgccttggcctcccaaagtgttggggttacaggcataagccatagcatccagcctcaaataagattatagttgtaaattaccatgtgaaaaagatgattaacctttataccacattccatttttgatatattcagacaatgaataaatatcatgatgtcacagacaataacatctgctctctattgaacactgcctaagggcagtgttctctttaaattagcaattcttagacttttttctttcagcaaaacattatatgagatgacagattcaaagtactctttcttcaatggaaaaagagatcattagaattaatggcaaaactaaccctctctgaatgaaatatcttaataaaatgttatcagggctccctggaatgtaaataaatgattgtctgcttctggaacatacaactaaaaacaggcacaaaatccattgccagcaagatagttattgatcatcagtaatgcctgtttgtgaatcatcgtttgatccctaacaaatgctcagcataaggtaatcaataaatgatttgataagcacatgaatggatggaactaaatctcatggcaccctaaatagtgacctatagtcaagatcctctaatgtagttaattgaaagagagtaaggagaaaacatctatttataagaaaagttgttgtaaaggcttgcctgtggaatgcacctttttcatcaaagcaaaggagatagaaatttcctaatcaatgtaacccctcccctgaccacagtaaaaagagaataagaaagagggaagtgggaggaaaaattaattgaagaaatcatgtggttttttgcaacaattttgtcaattttcagcattccccttgcctttgacttgacttgcatttgtctacatggacccgagacagtgacttactactgcataattgataaagctaggtctccatccgtaggggtttctagattaaagagcaatatagattaaattctcatatgtggtatctgtatactcagctacaaacatacacatcgatgagtacttgcttaaacagtcactgattttctttacattcccataacatgtcaattaatgtctataataaaggctaaaatagttctaaatcctgggaaaatcttaatggggggaaaatatatttgcattgtctccccggatagaagaatgtttagccagaagtttcttgctgatctgtaccatttggcggattggaactatttctggaggagtatgtgacataatattttaatttaggcaactctgagtgcaaccaacaaaaaaaaatcagatatttggagaaggttaataaagctgcccctgggctccttcacatgccccaggagtcctcacgatctgtgctgtgaccatgtgctcctgtgacatgtggcacagctcacttctgtggttattacagtgacaatagcaactggctgaatgttactgtatgcacagctgcttccactaattctaaaaccccaaaccacagagagatgtctcccagggattgtagaatgaagagcaaccattctggtggatataattgaaaacagaatgtccttttgcactctgtaaaatcaaaagctgtgataacagatccacctaaaaatgacctagaaaactgaatgtatagattcagatgcacatggcaggaaagcaggaaaaggacttgactgaagagactgaaatagatgagggaggtagcctcgggcccaggatgtgtggtcctctcttgttggaagcaaagaataatatagagaagagggtgttccttctcagcaaagggaagagacatagatgttccacaaatgagccacttttctctaaacttcaatcctgatggcttggcctgaggataacctaggtgcaatgtaatgcactgcacatccaggaacattgacttcagagagcagtagttattattactaatgggaggcattactttttttgtttttttttttttttgtttgtttgtctgtttttagcagcaatgacatttcacttctcccctaatctaggtgaacaaatatatatagaatatggttcgtttgtttaaaaaaaaaaaaaaagaatggctccttcggaaaatgctttctgttgttgcatcccagttcggggaagagtttcaggggtaagttatcttgcacatgcttttttcatcgtgcctcccagtcttttttatttctgaatcatcaaattccttctttcattttaaattagttggtctgaggaaaacatattcttcatgctaaaagtctatgagaatttccatttgatttcactatgttgagcgagggtatattcttgagcaaaggtattattttctatttttaagtgaggtttaagcatgtcgattgaactaatagctaaccaagctctactatgttccaagtaccatgctgaatactggaacatgcattataattaaacataaatatatgctcacagcccctaaaatctatagcatcatcacatttaaatgagaaggcagcatatgcagaatagggtagcattaaaataatggtttcttttcaaaataagttcaataagatgcctctaaaagatcaaattgtggagaaaaatgactttttttacatcaagaattacttcacatttttattcaagttctgttaactttccctaagctgatagagcagtagacaataatcggtaaaagctgtttcctgaagctggtgcctgttatgaacaacactctaccttgtaactgttcagtcttcttgctctgcggaccagctacccagtggcgctgcctggttggcccattaactctgctcagggcatgctttatcattactaaacggcctcaattcccaattacagggtaatggcatcattagtttttccatcattatttggtcataatgataagaaacagaaaatattgtagaaaattggggagaatttgggcactttacagccctggtttttacgaacatatccatacacacctgcacacttcagttcattaacagagacagaaactctttttctgatactcatagttactaataaaaatcaattgcaattgaaggagaaagcaatggggaatgatcatgttaccttttctgttcggtatgactctaaacagaagctgtatctaggaaagttcagatttaaaatattattttttctttcctacagggtttctaacatctaagaagcagatccttaagaagaaaaaaatgtcacttttcaacacatttatatctcagaaaaactcatattcaccttccatttactggaatattatcttcttatgttaaatttaaaaacaaaaatatttggacatctggtcctgattagattaacataaaaaaaccaatctaggaagaaaattgttaaagtttatttctccatgctttgtaagagatgtcatttctaataaaactatggtacttatgatttaataactaactgatttcactttgcatttatgccaccatcataactcaactttttagaaagtgttttatgttttatgttctatggtgaacacttcccatcagtgtggcatattttaataatcatagttataaactaatacttttgtaacagtttgcaattttcaaagcactttgagataagacctcatactatcctcaaaaacactccatctgtagtgtagacataatagatattgtctccatcttcagatgaggaaatgaagccatttgacttcttgattcagtctttgaacttagtctttttagtattactctatcagagctttatctatccatctctatatatttgccatcaaatttttgttttaatttttggaaagtttctttagattattattttcttttttctaaattcaagttcttcccgtctctggctgtagggggcctccttagatgtggtgaacatttttttcccaagggcttatttgtgtacctggcaggtatacagaaaactttcccagtaccaagaagcatcttcatagatgtcaatcaacaacgtgtctaccagccccagaatggaccacactcaattcaaaccttattttgagttcccgtctcctactggtagccagggagaacaaactcacatttaccaattattataccaaaatgcagttttaaaattatcgtgtctaattgtatcatatttttgtcttctttcttgatttcagactactcgtctaactacttatgacaatcattttccgacttctaaattaataataaattgttcttataaattaattctagtaattaatatataaaatacccaagctttaaagagcctgtttttttttttttttttttttttttggtagggtgattcaccctttgtgtgttggttttgagctcatattttgctgttaaaacattttaatttctgctatttttacattttcaatgatattcttgacatttgagattactaattattttctgaacacatgaagaattactgtaaatgaagcattactgtgtggcttttggtgagtttgatctacatgctatcatcatttatatttttactcttctggcgagatttttgactcaaaagaaaagaactacttcaacacaatcactgacccttatgtattattcaaagttcaacaagattctctttaaaaagggaaaatttgcaattggctctctcactttgccccttattctataaagcttcacaaagatgtttttaacagcacgactagctttgttcccaggtatgctcaaaaacaactagttttgtctgtgagatgtagaaacctttctatatttatgagttataatgaaatagttcacctcattgaggaattgtgatgaattatttctggttttacacataagtattgatagcattaaatttagaaggtagtatctttggaattgacttttacatcacaaagtgcccatttggttcacatatgagacttatttaaagacaagtctccacattgttactgaacattctttgaaaatatcacaggtctataactggggctatctgagtagtataacaagttctcttcagaataataatgggttccatgctccatttatttatgtttcatttagaggaacattacagaacaaggaataacaatagtataaatggtaaaacagttaggtgtaatgattaagtttgcaaaaacgtgagttaaaattctagctctgctacttaccagctatgtgtcctgtcaaatctccaactctcattctatctacccaacaggccattggggtaaaatgaaggcaagttgtgtaaaacacttagtacctgacgtatttttattgaatgtcctcaatatatggtaaattatattattatggtttttgctgctgtggttagatatttagttatgttttttgatgctgaaggcatggtatatatgaatatgcttgtcttatggagataaaactttaaaactcttaaagtctttggaaaatgcacataaactcaaagagaaattccatttaggataaataagaatattctatttacatcagaaaagaatattctatttacatcagcttagcctcttcaatctaaaattctcaagaatactcaggatttctagtccttcagaattattcctcctccaatattgcttctcatttattcttactaaacattttcactgtgttcaagtactcagcaatccacagtgctcatccttccttcttaggatgtctgataattagaaaatgccttctctgtttgaattatgctctttcttgcttcacttaattgaatctagttctatgtcatgaaagctatacaaaatgaatttaaactcagttctatctaataatacttttgatatgtttttgaaaacagctattatatatctcctccccttcgtgtcctctcctctttatatgacatgcttccgagtttaagatggtttctcatcaattcagtctctcagtacctctttaccaaggctgttcatgttttcacataagcagacacaatacctgagaagctcatgataaagaaccccatctggcagccatcgctgcatcactgcttcctttcttgtacttttgtcatcactacgtactgccaaccacactgtgccattggctaataaaagagtttcaatttcttatctatttaagttacaccctactcaaaccttatccccaccatgaattcaatggtcttattgctgatttcacacataaagcattatagttacctatttcattttttcattattacatttggtcaattgaaatctctttcagattttgatcttttcatgtaaaatatttgatatagcagaacagattactgtctataagtgacattacagcctaaacctccattctagttgatgcttattatcatcaatactccttttgattaatagttaaagtgtctgcaaattcacttgataaaagaggaataggatttaataatgaataggagttttttctccctatcccttcacctcaccttctatcatcttccaacctccatttaagagagttttatctttgcagatagtctctgatctgtaatgtaaaatcaggaaaaaaaggcattgtaaatgtaggaagaaagggaaagagtagaattgatctgagactaaagtggtatagaaaagaaagagtagggactgatggaaatatagattggaaatcatttttaattttgttgtttgagctgctcttaggtaaatcttagagaaactggtatttgtggatggcaagttgtacaattatcctgcatgcattgttccattttatctttagaaaataatttttaaacattttcaaatgcacatcttccaaaagtttgtaaatatttttatttcataaaatgtaaattttatgtaaaagctgtacctctaataaacatgtaatatgtaaaaaaaaattttcaaatggttttctaggtcaaaaaaaacccacatctgctgtaattagttgttgttttgtaggttttttttttccaatttacagatccatggacttgtttgtaccaagaaataagaacatcataccatctgacgaactgtggatcatttagtctgtgctttcactttcgaacaaaagtccatctaaacttgcatgtaaactaagtttactatattttatgcctttgtcttttcttatttcaaaatgcaaaaagatttcaataaatttgcaaataaagttcagagacatttgtaaaaaaactgaattgagaacagagactactttaatttaaaagtacttcataaatggataaatctgaataaacattttacgatatattcaacagttaattcttagctgtaagagggcttaagtggacacaaaattgcaaaacttagacttatttacttttatagaatgctcaaatataaatgttaatatcattaacagatttcacctgtgtggtctcacccactgcaaaccatcacacacatgatacagtacctttgcacctggttgagtgaactgggaaactgaaaaaataacttgggatttagatcatataaatgatttcttaaatattgatcaacacctccatcttcatttgtctatgtcgatacaacacaattatcattgcttttctttctttagtcatgaaatatattaatggaaatatgcaagcattatacttttatgtagacaatatgtatgtattgtataacatttccaattgagctgactttctaattcttatcagaatacactaacagcaacttagttccctaaaagatgtcacatctgctctcatgtctcaagctaactttgtcacctctgggtttctgttattatggccctgggcaagttacttcacacctctgtgtcttcattgctcagatgagatgactggtctaaatgatcacttcttgctttaatcttttattattggatgatatcacagtgattatctagttcttcttagcagctgggacttaaccaagacaggtcaagtatttttaaaaatgacaaaaacaaaacaaaatactatggtttcactgccactttttcaaagtgacatcctgttcttgggaatgagaattgatgatgtcaatctaaatatgaagaaaaacaaatcaatagaattctctgacatgaattgacccactgggtgtattagcatcataattttgttatgggcattttggaagaatgtcagcataactcctgaagaagaggggcctagggcaggatatgacaaagaaaagaaactacaggtactttaattgtgaaaggatcagcaggtgccaaggaagaaaaccaaattattcctaacataagcaagatatagtagaaataaatgagacataggaaaatgagagctactttgagtaaattgctcgaagacctcagagccatcataaccagcttaacgtaatacagaagaaatagttttgcaataaatctcctctattcattttattgtaagccaaatgtaaatcttcagttaagttccttaggatgaaaatcatctttaggaaatgtttctattcatcatcttcacactagtataaaggaataattttggtgaatagaaattaagaaaagaaagtggggcaaattgtttgccatttcaaatgatcatgaacatgttagatctgtttataagaacagcaagagctgatattgggcaaaattgcaaatgagcagtgccttttttacccctgatatttgcccctctatttctttccacccccactgtacgagtatttttatgacagctacactctatatgcatttatttgcacaatctaagctccacggaccttgtgtgaccttcccttgccttccagactttacaatatggctcacatggtttcatgttacattttcatgcccataaaagtaaggcttattcaacagatatttttaggcatgtagtattagctgggcaaagattcagtgcctggatatagtgaagaatgaaactgcccaggtcctcaagggccttataagaataataagtgcttgtagattataggactacagacaatattcaaataaccataattgtacattagatggcaataatgctgcaggaagacataagccaaagagaataaaggggcagaaggaatagtctctaatgtaaagtggcattttagaggggacccaaatgaagagagaaagcaagccaggaagtatgtgaagaaagagcaaaaaagccaaggggatcataatttcaaacgtatttgaatgtcatggaaaagcaggaggccagaaaggataaatcaaagtgggcaaagtacaggaagtaagaaggttagagaggtagccaaggccagatcttataggaggatgttgtagtccatggtgagaagttaagattttttgagtgaagccaccacaaggttttggacagaatattgacaagatctcatcacataatgatctatatgaatggactgcataataatcagggtgaagcaagtaaaccaattaggaggcattgcaatggtccaggcaggaaatagtgtggctttgattaaggtgttaacagtggaggtggttaaaggaagtcagattttgtacatattttaatggaagaccaatattttattgtatcttagaattggaggtgaagactaaggatgtgagagagattgggaaatcaaagatatctccaaatatttgtcctgagaaagtagaaaccagagtttactgtttattgaaagaggaagtagtgatcgagcagatttaagcaggcatggggtggatagagaaaaccgtgcctccagctagctctcaggttttttctcaccctcttgacttaactttgtttcaacaaaacaggctttcttgctgtcacttgaaagtaatatgcattttacctctttagagcctttatatttgttcaatctggagaacattattctcagaatgcctgtaacacatccatgtgtagatgttgaatgggcatttgaatgtacgagacaggggttccaggagaggtctggacagcaggtacacattcaggagaaaatagatcatgataacgagaccacagaaacacaaccagttacataagagaggggaataaaggaagagcagtgaccaggaaactaacaaagggtttcaaaaggaaagggctgatagtgtcaaattctaataggttcagataaagactgagaatttaccatgactttggcagacatttctttcacctgatataatttgcccctaacaactctgccatttcctgagattcagccaaaacgtcactgtctccttgacatattttctatatctataatttttgttttactcctctgcctccaaaaaagggataattgttctaaatcactagcttgttttttatgttctccctttaaaaaataatcatattgctcctacatcatagcaaacacctagtatattttaagtatttattatataaaattttagacaaaaggaaaagtgaaggaggaacatagggaaggaggaaggaaggaatgcaggcaggcaggcaggcaggcaggcaggcaggaaggaaggaaggaaggaaggaaggaaagtttctagcctgaaatgtttttctaagttccattacttttttttctaggatattgctgggtgactaatacataaaattaattttgagtaagccattaatgcccaataatggttcactgtgttctatttttcttcccaagtttatgtggcttttagcaggagaatttctgaaaataaggatttttttgaacataaaaaactaaatctatgatcgtgtagcatttatttatttattacttatttatttatttaatcacagaaacatgttctcactatgttggccaggctggtctcggacttctaggctcaagtgatcctcctaccccggcctcccaaagtgctggaattacaggtatgagccactgcacctggtctatgcagcatcttaatagactagaaagacttttgccttcacatcttataacctttatgaagatattcactgacctttttatgcatttattattggtccttcttgcaaactatgatgctgtgtaatttctaagccatactctgatagttgtttacctcaactaaattatagctgaaaaatattacggaacaagagtgagaagatgattattacaacactaaacttgaggattaaacaaaacaaagtttagtactttataaaatctttataaagacttaaataaataaaagtttcctgacttttgaaacccatttcaaagaggcccatcctggcataaattaaatctaggaaagactttaaaaaataaatttagatgttatttgtcatcacttgaggagcttcatttcttttctgaatgagtagaaactgaactcaaaatgatgctttttacaccaccaagttattgtcggaaagcctcataccaccacacaacttctaacttggaaaaaataattcaaatattttcatacatgcaatgaaagtaattattagcatggccctagaaagggttagctttgccaaaactaagtggtaaattgatccacatttaatttggtttcctatattatatgcttctgttcagattgtctaaaggctagataaaacacagtgatgcctgctgtccatcaaatgttaaccagtggaatttgtgctatggcgtttattattctaggaatagaaacaatccaagaaggataaaggcagaaacatgagaaaggttgtgatgtcttgaagagtcgacttagagcatatcaagatgtactgtggtgtcatagagtcaagggaaagaaactgatgtcagactggagtagtaggctaagatcacatgaaaaagatcctgtgcactctcctaaagagagtgaatgatgatcccaggaaccaatgtggcaggcaagtctcttttcctttaccagctctgcttcgtagtggttgcctgctgatctctgttgagaattaccaacgtactatatgttcagcagtaaaaattgctgttatcaatcagaaaacctgttggtcaatggcttgatatctgcagtatttgccaagttcaccatatataacaggagccatcaatcttttttttttaaccaaataatgaaatatcaaggatttgctctttggaaggacactgctgggaatgactagatggaatggaggtgacagagattagaaatagaaaagactggatgatacagcacttcagtttgagaaatacaaaggtcaaaaaacaggtcagtgatgggggaaatgaaatttataaattaaatacattataatagatctcctttcaaggaatatttgacaaggtcacattgtattaatctaataattttcctggagaaaaggttgaatgttttcccaaaatccattgattcccttacacctctagaatagcggttcttaatttttcccaacgtccatgttttcaggaagaatagtaatcctaaacaaacataggtgagacaatggactacatggaccacctgtcccccaagtttccactttctagtgggaattaaaagtgagttataacaaagaatagagagggttgaaatcacaattcaggtaatcacagcccatcaattaaaagcaaatgacacacaaagattgatccatgaataatgatggttgaaaattaagaccaaatcaggatagcaatgatcatatagtatgttaccgaaattttcaaatgcttatgtaagggtcagtttgcaataatgctaagcaatgtgtggcaataggaattctaaaagaagatggaaagaagacctcagtaaatgctggtgagtccttaattttaaacagtcaagatattttgataattctgataattaagaggggttactaggaagtattccttagctataggtaattatataataatacaacaacaatcaccatctccaccatcacggctactaagtggcatttattaagaaattattatgtttcaggcatagccttcgctcttaatcaatgctctattgtgcatcctgtgtcttcccgaacgaaggtattgtttttcaatcggtttatgtattagtttaggatctactacgaggagcctgatagctgcagttcctactttggaaaacactgcttgaaaatcccattcacactccagacatggatgtctcataaatggagttcagtgggtttgaattcctgccaaaagtcctacttttgccactgagagagtcctaatttaattttacctgacaaataataaccactgctttatttttatctgaaatgcatatggattcttgatgatatatatattaagctttccaacaagacaggattaatgttgaggttattttctcatgtatggggctagactgaaaaaaaaatccttttaatcaccattttactgtcatttcttaaacttcctgcagcaatctagtagaacctatccagaagaataaatgaagccatttttatatcacatgatggttactttcataatttccagtaggaaatggagaagctatttattggtctccggaatttaaacatttaaaaggaacctactgttatatttattatcctttacaggaaatgcaaagctctttaagacagacaatgaacagatagcttcataaaagacactgcaaatttaataagctacactatcttttgctgattcctatttactattcatgaaaatgggatttgggtgacttctctttttacatcttgtaacaggaatttcaagagaatgaggaacaaacagcatgagatccatgtctcaggacattatatttttaaattaattttcagcctcttttagcactgtatttatatgaatcacagctcctttaggtattttgcagaatgacacctttgtagttgagtcagataatacacatgtatacttgtttgtacaatgataaaaataatagtcataccttgagtctatatgtccatatatacctttacataacatatatctctttatgtgtgtgtggggatatacatatatatgtatgtatatatataaaatagtatatatactaagaagctaaaactaaatgaggatatatatatgtatatatatccctccccaaaaggagtaaaaaacattccacctacaaataaacctatgttttgtgactcagtctcatggataatgatcagtctttgggtatttacataattctttggttttggtccctttgaagctaggatatttcaatgcatttccagagagcaatttcaatacaatatatcagtaacaactgataccaatgcatatttcttttctaaatattttagcacacagaaatttattttctgtttaatgtttctttttgagtagatactgatggttttatcagcaacatcctggaacctctctgaattaaattcttttattctctcattcaaatcatgtattccttattatttatgcataaaaccctgactgatagttctgataagacattttctttaaatttgtcttcttagttgctttttctcatattaagcactcaaaattattttaaccatattttttcttaactgttatattctttatgaaataatgttactgaaaagtgaatcagttgtcacttcaaattttcctaaaattgatcaactaaattattaacattaaaaataatggtcatagtataaagtttttaaattttataatctgatctgtcaatcattttcattatggcttctgggttataaattattctagtacctgtcctttcaatgctaaaataatatcataaattttactcattaatacagtgtgagtaggggtttgagataagaagctgaaaatagatgagatttatattcatcaacatggccaaaatgatacttatatgtatatatatttaacaatgttaaagtatataccagaattattaaagaaaattttgatgaaatggaagggaaatcactcacattcctctgagaaaattttacaaataaagttcagtgtgatagatagataagactgtgatttctattcatttgaatgggtgacacacggctgaatctgaactacatgttctgaaaatttacctcttcctggtttaacaaaagagacagtgtgtaactaccataataaccagctatttaaactaattatttccattttgttcatgtggaacttttattgactggactgctttaggaaaacaggtcttctgcaagtggattgtaaaaccatggcagtttttgttgctagtgaaggtggcattcagcaggtggtaaaaaaaaaaaaaaaattgaggatgttgcttggagaaatacttattttgcttgttttagcgtgtttgtgatttttatttccatccagagtgtgtgtgtgtgtgtgtgtgtgtatatatatatatatatatatatatatatatatatatatatatagaattgagtatttgttaatatctatcttcctcatgaaataaacatgaaacttaagcattgggcccaagagagtactttttaatagcaggaaccagtaagttgaatctcacagaataatgaaatttgagacatgcctagaaatttagagatcatttattcagtaactagatatgcttaagaaaattctcaaagccacacaccttaataataatgttcatttttgatcactattattaataataatgttccttttgatcactattattattaatgttcatttttgatcatcattattaataatgttcattttgatcattattattaatattattattattgttattattgttaataatattattagtgttcactttgatcattatttttaacattcaaaatgaatcttaaaacagcaaccccaagctctggtgagatagcaatttatggcaaaagggtagattttctgaatctgtaatttttcaggcatcctgcaattattgacaatgactccattcaaactagatgagttgggttagatgagattacatttggaaacattcactttcaatacaaacttcctggttgaatcagtagtcagcaggagggctttgctataaagcaatcctgacacaagcttttaagcagtgagtaataacactctttaataacatgaatttctcgttatcaccaacactgatggtgcagaaatcatgctgtctaggtacaatgagttattttatggccagcaatcaaagcgccaccactttttgcccaaagagaaatgtttcacccctctgacaaaaatgctgcaaggcttaatgataaatcaatgataaataagattgatgtgaagtatttcccgtagtataaaagaaatatgccttatggagaggaatcattattagagaggctgactctgcaataatgtatgtcactcccccaaaagatagttagtactttacaggacataaaggagtcactcaggtattttcatattgaatagtcccttttcccttctttgatgatgaatggatgaaggaagccttaactgatatcaaagagaatagcaaatcggccgggcgcggtggctcacgcctgtcatcccagcactttgggaggccgaggcgggcggatcacgagctcaggagatcgagaccatcctggctaacacggtgaaaccccgtctctactaaaaaaatataaaaatcagccgggcgtggtggcgggcgcctgtagtcccagctactcgggaggctgaggcgggagaatggcgggaacccggggggcggagcttgcggtgagcagagatggcgccaccgcactccagcctggtcgacagagccagactccgtctcaaaaacaaaaacaaaaacaaaaaaaaccccacacaaacaaacaaaaaagagaagagcaaatcaatgaaatagagaaaagtgatctttgtaccagagcaatagtggatatattttctcttttcccattgatagccagattcgacctttctgacacacactattagagcctgaagcatcctttctgtgagataatgaatcccagggttggtagaaaccataacaagaggaatccccaactgtttgtgctgcttccttctggctgagaggaggtgtgaattgtattccctccttggggatgtaaaattcttggaaagtttgtcaccactctggaggtgaagaaagctcagagtgtggggagagtttgggttcaagttgcttttctctctctctttctttgtttcattcattctctttctttcttttatctttctttctttcagagcttattgtgttaagaaaatctcatctctcatttattttttattgtaatctaaagtaatgttgcattaaagaaaaaaaaaggtggaaatattttaatagtcccacaggaagggtttacattcctgaggaaatgttgtactttgcagagattatttagtctctgattaatttgtacacggataaaacaagtttcatgagcgtcactgcaacaattacatgaacatctagaaaactaagcaagattcttgctatctcagaggggaacaaggattgaatactgaatttttacaaagaaatccgctcttcttaactaggattgtcacatgattttcaaattaaagaatggaagaaaatggcattaaaatggaaatagaagctccttgtttctgaagactaattttgaaagagtgtaactggtgttttccagaccttcagaaagaccttaaacacacccaagagacttgagtttgatagaggaaagcttggtgatgttgagctctcttaaacacagggatggggtatgaaagataaatggaaaatctccttcttcaaagggtttccaaaacagttcacgtggtgatgacagtgtttttgcaaaaagcagacactaattagaaaaccttctaggtccttctttgatgtgtagctataattattctaaagatctggaaactggcagagttaaaggggaaagtctaaataacttttactctattcagacatagaagacataagttattttgctgtaaataagaaaatacaaatataaaagtagttattatttagtagcaattgttttaatataatgatgctattgtaacccaggtttcctgggttttggggtacacactgtgaaaaagtgtccacttataactgttgcaacttgagcttttgttgtttcaaaaaaattccaagaagctcagccctgatacaactttacctctagccaatatcattaattattttcctaggcaaaaacagtcccttccttgaaccaaaagtgagaatattttcctccagttcacacttacttaacctaagagtctgtaatttttctttttcttctccttcagttttaacttcagctccaagtctcatctcaaattgtttaggctattacattcagtgagaggttgattatttttattttattttctcctaaatttcaaatagtgtcttactactacaattcctagctaaaattctgcaatgtcactggaaagctccatgccttactatctagatttatagttagttttttattggtttccagtttttcgtgaactttctgggactcaccacctttatctcttgctcctcttttttcccaagtggcttaataatgactagggaccttaacagaaccaaatttatcaatattagtgaaggcacacacacaataacaacaaaacagagacaaaatgggtctatgactcaagagtgtaaaaatgcatatttttgataaatttggcaatttgaaaacatttggcaattttttaacaaagtttaacaactggagcaataattccacttttacgacttagcctatgaatgcgtagttatgcaaaattaaaaagcaatgatactgtctattgagaatcagttaaaatgatgagacactggaaatagcctaactgtccataactgggacatttgtttcctaacattcattgtatctaaaatgaaagatcatcaagctatgtcttaagaaaactttagccaaatgctctttgataggtcttaaacctctggaaataaaaaattgtgacaacagtggttctcaaatgttaccaaaaaatgtagacatcataaatcacaaaaacaaattaaacattaatcatagtaaatggtatatatccaaaacacagggggaaaagcagaaggataatgataagtcctttccattgcgtactaggccattttcttgtaagcccataccgaagattcatctatagcttcagaagaatggaacacaatagcatagggctcagaaaatttatgttctgtaaaacttattagatgttatgattttaccaaagagtcatggttggttcactgtgtatgtttgtttgttttactgtcctgtagacattaacctgctatgtatttcagtagttttgtttgtttctcccacagactatggaaagcgtatttctcagatacttttttctttcaacctgctttttcaccctgctggctccctcatcaataagttaaataaaacaaacttgaggtgagataatagagctctgactggcaactacgattcccaaccatcactgcaactaatatcttcctaggagaggatgtcaatgattcaaaataactcccattttgaaacaaacatccaactataagcaaaacttatgtgcttacctcctataatgttgaaagttcagatatggtaatgcatttttaaaatctcagaagccatacataataatctaaatgttatattatattttcagtggaggataaagttgcaaaatccctctgagtctctacatgcagagtcaagatgcattgttacaaagaaaaatattatttcaaatagcctttctatcatgatctaaatcttagaaaatatatataagaacaagtctagagaaaatacactaactttcacatagtcacatatgcatccctaaccccggaaaatatatacccaaccactacagtggttatctataggatcaaggattaaatgaaatttctcacttttttttatcagacttttctataagatataaattttgtaaaggaacggaggaaaaatatttcaaataagagcaggcagaaggataagaaaaaaatcctgaaaagcagtatatattagacaggagaaacttctccacctgtctccctctgcccattaatctccagtctatgttttattagatagcggagaaaaacgtttctttttgggtgtaatagcacagcatattcttagtcagaattatttaatttctaccaatattttgtaacttttgtacctttaaaactaagtagtgtacaaataagattgtttaatcaactcatttatacttcatgtaaaatttaattcaaacataatatgatttatctctcatgtaagtattatttctgaattattggaatagataaaatagaaaatatcacagtatttacttttatcatggaaataaaaattaatttttccacttggtttataaaatatagattgataaatatatgagaaaagctattagccacctaaccaaagaaaagactgttattaaaactaactcctgactcatagctaaagttggttttactcataacctcattctgcctatataatcacacgttaatatagtttattgttgctaatttagggaagtaaagacagtgcatttgcctgaaaatcttgagttaaatggtaaattagaatcattacaccaatcattatggaacaggaatggactttggcattttaagtggagttgtgtctattttacaagagtatctcttatctgaagtgtcaccttgatttttaagagaaattcagatgcatggtcaaacatttaggtgttctacaaagtgacaaaatgattctcagcaactaagtagaaaatagtcatttattgtcagattttatggaaattttatttgaggctagaaaaacacctaatgtatgcagtaaatccaaaagcaaatatttctatttgtttctctaataagccttattaccacagtttataaatattacaaccatggagcaattatctgtaaattattgtgagcagaagcaatggtttttgaaaaggatttctagaatatccaattcctaaaatacctcagtactggtgggcagcatgtaagaatttgggagtaaagaagaaaaaattatttttatccctgggaaagccctggagttgtctccttaatgagatcacagggggatccaacagctgcccttgaatcttgcctctctctctacatgtttgttctctgtaccatccctctgaagcggatctcactattgattgccccctggcaagcagacatgtgaccaatatacacctatattatgagcctagaccatttaaaatcctgaaaacgttttttttctcttcatggaacacataattttttggcttgactttgaggactgatttgagatttgaacactgtaacactatttttcactccataataccctcttttctagagttgacttcaaggatattgttataggttaaattgtgtttcccccaccaaaaagatattttaaaatcctaatccctagcacctcatatttggaaatagggtcatggcagatgtaattagttatattaagaagatgtcattcaggagtaggtggacccctaattcaacatgactgatgtccttataggacacatacatggggagatgaaggtagagattggagttacgcagctgctggccaaggaacaccaaaggttgccagcaaaccatcagaagctaggaagaggcaagaaaggattgctttataggtttgagagggagcatggccctgctgccaccttgagctcagatttcttgcctccagtactatgagcaatacatgtctattgttttcagccacccaatttgtgaaactttgacatggcagtctgggagattaatacagaattgtaatataaataagtcagtactagatttagctctggttattacatcacaaagtttaatgttctgaaacttctttggtgaataggatctagataatctacaaattcaaactaacttcattactcgaattaaactctttattacaaaaatctaacttatcctttagctctattatccattccttcattttagtcggctgagcacctgctctgtgccaagttcctgggtgtaccatcttggacaggaagtctgccctgtctttacagagcttagatcctagagagagagatttactcagtgccaattcttctccctacacttactattctcaagcacaccaacacaagctctatgatgatatgcttgagatatttttcgggcagtcacaaagtgctggagcccacttggcccctgaaccattggggatcaactcttaatcagtgagagagaatttggtgtctaaatatcccagctctcttgccccactctgaagcatgttatactgttgcctagacttcccttttcagactgagcttcagttgcccctaacaatagcctgcccaatgatgtatctgaattcatttccttccttcacttctccactttcttcctggtgtttcctggggtaatatccaaaataagctacttgaatttacatgcttgacacaggatcagcttcagggaatccctgaactaaggtaactggcaaataattttaaaaggcacaaaagtgaattaattgcatactttccaactgtaatgggtgctataaggtaacaagagccttcagtagatgatgactggaatgggagtgtattcctttcttcagtcagggtgatcagggaagcttctctgatctagtgaccattaagacctgcgggaaggaaagaagtagccatttgaagagcaggagcaaaggcgttacaggacgctctatcagcaagtgcaaaggctcttaaattaccaatgagctcatcatcttcaaaaaactgaaagaagtagagagtagagcatacattagaaggaggaatacatgctaagacaggaagacttttgttttgttttccatatgcagtggaagtcatagaatagtctatggtaatgaaggaacatagttgaatttacattctgaaatcactcttaccactgggtggcaaacccattgcagagtgatcaaagtagaggtagggagagagaaatcagttacaaaaagaggtgctagtgacaaacatgaagagggtggcaatcaagatggaaaagtgagagaagtgtaactcacacattctctcaaatgtgggtaatactgtgaataatattttgaaattaattgatattttcttaatcatatatctcagacctgtttttatattagcctgcaacattctttttaacagtttcagatgtttcctgaaattgggtgaagatttgagatataattttttagaagcgacaagattttcggatggatttaagtgggtggagaataaatttaaggaaacaaggattattgacaaatttctagcttctgtggtaactgtggtgtcctccaatctagtagcattaatatgagaataggaaagacacatggagaaaataacagaatagaatgcaggcaagtcaccaaaggggagtttagagctctgtagttttatgcacatcatctgcaaatggtagtgccttatacatagtacacaacattttttttaatttttaatttttttagtgaatgaagataggagtgctctctgaggagcttagacatgttaataagtaaaacagatacatatatagttagcatttattagaaacttacaatatgtcagagggtttacaggtattatcttttttatttaccacaaaactgcatcaataccactaaaaatcctgaggaaattaaagaatgccaaacactctacctaaggaattgtaatgtaaaataactactaattgaggaagggataaagtatcatcaatgagagcacaaataagagaactatgaattctgactgagaaatgacaggaagttgtatatatgaaaatttaaagacgacatgaggttttcaacagagaagaaaggggtattttagggaaaggaaattatttctgcaatggatgagaacaacagccatcatcagatttctatttcaaatacattttctggcttagcatttattcccattacataattttttgagtaaactcactttaatgtttgccccttactaaaactgcatgcttcataagtgcctggatttcacctgagttgtacaacacgagaaacaggtaaaagtaatcactcattaaatgtacatgtatgtgaatgagtggaaaataagtgaatgagtgaataaaagaacaaatgaagaacaaataaaagaacaaataaagtaatcaaggagtcagccggggcgaatataccgtagttaccataaacttcaggggggaggagtggggcagagcacagcgcggaaggtcagagtacaagcctggaaggagactggcttgtgtgaatagctgctctgtctcttgatttctgagcaagcttggaaaagttacttaaaagtcaattaaaccttgtgaactttaattccttaaaaaactgagagtgatataggagttaggaataaattacttagccagatagtgaaggtacggtggtcttcagtgaggttttccttttaatgaaaagcaacccccaaatcattttcttttctaatacagagcagcctgtaaaactgagctgcagataatcaagctggaagctcgcacgagtgaataccagcagttgggccaacacggaaaggttacatgggactaggcatgttcaaaatggcagccccctcttctcttctcttggtcaaaccaggtgtagagtgagaagacaatatggcgctggccaggcaaagaccctgtttgcataataagattagagtggggcaaccagccctccccacagtgctgtgtaaacgtcacacctgacggaaccaatctgtgggccctgtgtaaatcagacactgcctcctcaagcctgcctataaaatctagtgcagtctacccaggccagattctcctttcagaagctcctctctctaaaaagggagagagctgttctcctttctccttcttctgcctattaaacctctgctcctaaactcactcctcatgtgtgcccgtgtcattaattttcatggtgctatgaggaaccccaggtatttaccccagacagtgatgtgcttcaatagtaaaaatagtactctactcactggattatgttgaggattacaggagacaggacatttgaaacactgagtatagcataggtattaaataaatttaagttaactaacagggggaaggaagtattgtctaaattcaggtgactaaataaagagattactgagggcaatgacaaagacaaggagatgataaggagaaactggaggcttctattaaatacagtctataagatttgaggtatgactagagtataaggtatagagtataaggatgtcatgagaactgtgcattccaacttgcagccctgcgtggatatgtaccatctattgacactgggaatctaggcagacaagcatgttttgggtaaagaaagtaattccatttggaatatgttaaactggagatcaccgtgtaatgtatatgccaaacctacagagcacttactctaggtcaggtactacctaccgagcatttactctgggtcaggtaccacctacggagcgtttactctgggtcaggtaccgcctgcagagcattcactccgggtcaggtaccgcctgctgagtatttactctgggtcaggcactctgctttacacttagaggggcagagaacaatttatataaagggaagatgtaagtgatgcaacaatcattcttcaaggggtttcactctaaaaggagaaataaatacacacagattaatatcaaaatggcagatttagaatttactttgaacctttgcattctgacttctgtaccctatgtctatggttgtaaacggtgatcctcataggttttttgcaagataaccaaagtgtattttctaagttaaatcctcctggttgcttctgtctgctgcgaaaccctgaatacttgacctggcctatcaggtcctaattacctctcctggctcatccagtatcattcaccaccccactcgaccatcagtccttgaattcactcacgatgttcttgtagtttgttacaccagtggtcctcatacatttttttgccctgcatgccttccaataaaactttttgagcatgcaatcctaatatactatatatttatttatagcacactttatatgcaaatgctgctgaactaatattgtatgtgtcttataagactacagaaaataatcatattaaaggttgaaataaataaatgtaagtagaagttctaacactcaatgaatatatggtttttgagactactattttaactatgctgaacttctccctcaaggctgcacacgctgttctcctctgcctagaagctcttgctttgtgagtaagattaattcctgctcatctttgagtttaaatgtgacttcttcagtctgccccatccatcccggtctacattaaatgcccaattaggtatttttctagcacttggtagtttccctccccacaacatttatcataattgtaacttaatctgtatgtgatttttggttaacgtctgtttccccactacacttcaagagaaccatttgcttagggtaccttacacactattgcatcccctacctcgttggttattcagtcccacccacttttttaacgagttttgatgactaaaactaatgtcatgcactttacaacatcattaccctttattcagtatcaccttgtgttcccccacgacaagatcaccaaagcttctgcaatgcaaggaaatcatgtataaggcattctttcagctttttctcctatagagactttgagttagaaactagtgaaataataattctgtgcaaataattctaataattacttttatggaagcattaaatctagggcggtataccacaacagataagagtaagggctctggagctctgattgcctgggtcaaaatctgggtagcagaacttaggagctgtatgactgtgtatgtcacttaacctctccctgttcagctgcctcacttctagagctggtattatggggttacttttggagtacattattatgtctaaaatactcagagatgtgtctaaaaatagaaatcactcaataaaagttcaccattattaatatacactaaacagcctattccataaatatctggagtttcgatttaattatatatcaacagcagcttcactttgcgtgtataatccccatccaaactttccgatcatggatatgtaaagcactttaaaaggtagtctaaaaaattaatgtaaagaagttacatggtatttacatttcaaaaactgggtaaagcacatttgaactcattgtgaatacaagccattccctgggctgtgacatggggacattttattaaaagaagcagagaactttatttattgctcatttctcttcatggttcacagcttgtaatgatttgaaccaacaaaatatctattatcagtgtgtatgcataagcatatagtaagtatgaaagatatatattctagtattaaagtctcccttttctttcttgctcataattgacgcgctctttctgaagaggagtttgcagtggtccgaacaaagatcacgatataaaaataaattatagtatgtatcccttggtgcctcactcataaattatttctctccactgatgctctttcatattcagtggtagatttaaaatttccttcctcgatattattcatacaggacattgtagttaaagagcttgccttttatagctgacaggctagtagagtccaagcttcagatgagggaggagggggtgaaaacacggaccctgtcttcttcctttccctatttactgccactcattacatgcttttgacatgacttctataaacattatcaatgagtgatctggggagtggaaaaagaggaaaaaagaccgtggaagaaaagttgaagaggatacaatacgattgcaattcctatccctttaacagggactctgtgctccaactctgcctgtttcatgtttaatttggaagcaattgttctcaacagaggtcacacatttcatcatttgagaactttaaaaaatgatcatggctgagatactgatatatttattcttcttaaaactttttcaagttcccccggtaattctaacttatagccaaaattgagaaccactactctaaatcatcagatccattcagtgaattcaatcaattcagtccaatgaaatgcagtcagttatagaaatgcagacgacctatagaacagaggtactcctggggttggagaaatgcaggataggtatagaacaagtctgggcctgagaagagtgacctgaagccaatgcacaagctatcccgtgttgtgaggctaggaacaagaggtgcgccgggataagaaaatgaacaggtttctggagagtgcattctagtacctaatttgagcaaacatttcaaaagtcacaagaggtgggcagcaggagccataaaaatgaaaatcaaagtataataataagctcaatactgagatcacagacaaaaaccaggaaatccaatggaactgaaaaaaatgataagacaataagcttaactaatctaggcagaaagctttctgagccaggtaaggacattttgaaacagaggccgtgcttctgaatcacttagtctaagggtttgagcaatacagaatctgtaggcagaaaatggctagaggaatactttcctaaatctggtttcttaaattattttgcagtcaaaatgtcagaggtatttgaactagagtgactctctcttgaataggggttggataaaataaggctgagacctactgagttgtattcccaggaggatgggcattctaagtcataggatgaaataggaggtcagtgcaagatacaggtcataaagaccttgctgataaaataggttgcagtaaagaagccagtcaaggctgggcatggtggctcatgcctataatcccagcactctggaggcccaggtcagcagatcatttgaggtcagacattcgagaccagcctggccaacatggtgaaaccccgtctctactaaaaatccaaacatatatatatatatatatataaaattagcccagtgtggtggcagcttgcacctgtagtcccagctacttgggatgctgaggaggaaaatcgcttgaacccaggaagcagacagagggagatcacatctcaaaaaaataaatacataaaagctggccaaatcccactaaaaccaagatggcaatgagagtaacctctggtcatcctcactgcttattatataccaattataatacattagcatgctaaaaaacactcctaccaaccccataacagtttacaaataccatgtcaatgcccggaagttactctgtatgctgtaagatggggaggaaacctcagttccaggaactgcccatcactttcttagaaaactcatgaatacttcgtttattcatttaccccttatttagcatataatcaagaaataaccataagtatactcagttggcagtccatgccactgctctgcctatggagtagccatccttttgtttctttactttcttaataaacttgctttcactttacaatatgaactcatcccaaattctttcttgcacaaggcccaagaatcctcttttgaagtctggatcagacccctttctggtaataaaaacatccatataattgattatgtcttagcctaaatacactagctaacaaaatgtttggcattaagtgaacaatagacccttcagtgaacttaattcttccttgattaacttgagaacccgatcggcaactcttcttataatgtcaagaattaagcagattcatgagaaatggacaataatatcacttaagaattggcaagtaaaaaacagaatatttgttctttgatgttatcaacaacacgcaggacataaagaatttataatatgctttgtgactgtttattgtaagtgaatagctgctttgaactatagaaagttactaatagtataaaaatcataactctacagtgtcacataaaagaggcaatgtaaagaaaataaagacattataagagaaagagctcacaatttttaagaacttcgttattaaacaaagataatgatagaagaaagactgaatcagtaatctaaaatattagtaaataatgttatccccctggttagaggtaacaataaagctccctttcaaatctcatgagttttcatttaattttactaagggatacaatagacggcaagagcagatactgcagctgtaagggatacaatagacggcaagagcagatacgcagctgtaagggatacgataggcggcaagagcagatactgcagctgtaagggatacaatagacggcaagagcagatacgcagctgtaagggatacaataggcggcaagagcagatactgcagctgtaagggatacaataggcggcaagagcagatacgcagctgtaagggatacaatagacggcaagagcagatacgcagctgtaagggatacaatagacggcaagagcagatacgcagctgtaagggatacaatagacggcaagagcagatacgcagctgtaagggatacaataggcggcaagagcagatactgcagctgtaagggatacaatagacggcaagagcagatacgcagctgtaagggatacaatagacggcaagagcagatacgcagctgtaagggatacaatagacggcaagagcagatacgcagctgtaagggatacaatagacggcaagagcagatatgcagctgtaagggatacaatagacggcaagagcagatactgcagctgtaagggatacaataggcggcaagagcagatacgcagctgtaagggatacaataggcggcaagagcagatacgcagctgtaagggatacaataggcggcaagagcagatacgcagctgtaagggatacaataggcggcaagagcagatacgcagctgtaagggatacaataggcggcaagagcagatacgcagctgtaagggatacaatagacggcaagagcagatactgcagctgtaagggatacaatagacggcaagagcagatacgcagctgtaagggatacaataggcggcaagagcagatacgcagctgtttatccaaactcttccttcccacacccttgccagtagttgcaccctgatacggtttggctgtgtccccactcaaatctcatcttgaattgtagctcccataatccccacgtgttgtgggagagacctggtgggaggtaattgaatcatggggtaagtttttcccacgctgttcttgtgatcgtgaatacatctcacaagatctggtggttttataaaaggcaattcccctgcacatgttctcttgcctgccattatttaagatgtgcctttgcccctccttcaccttctgccaagaggctgccccagccatgtggaactgtgagtccattaaatctctttttctttataaattacccagtctcgggcatttcttcatagcagtatgaaaacagactaatacacaacctcacctcccagcctcaccactatgtttcagaagttgaccacccctttggaacaaagtcaggattggtctaggccaatcatgatgctcacaactctatgtggcactttgaacggatgctgccatatcactaccagcttcaggataaaggcaatagatggaggactggagagtaagagaactacaaagagcatgagatggagcccagcttaatgataatggaagctaacaaatgctttacttacaaaatgtgacataaagaatggaattttgcaatgaaaatcatatacaattatgtgtcaaggttattaaagattcatcatttaaagctgatactttaaggactgttgtgaatggctgcaaaatattaggttaaattatcacttgtctttggagacccatgatttatccactgaggctgaagaattagaataaaatagtaagaaaagtcacaccattggggtgtggtggctccttacaggagtgttgggtaaagatctaaaagcaagagatgggctcagactgaagatgacccacctgaaagcagaaaggcaaaatcatagagcttttgaaagtgaaaactttcttcctctatacctccccacacacacacaaaaatgaaaattgtctgagaatataatctttagagtcccatagagttttttttaaaaggcagtcttgtctagttcaaggtaaagacagtgcagaaacagggtaataccaaaggcttgttctttaaaatggtttatagaatgatcaaaatttggcaagtcttattcaagacaaaaagaaacaagttgcaaaaaaattataatgaatgaaaaagtgagcatatttaaatataggagcaatttaaaactctgacaatgaaatacaatctatgacaaagacaacatgacgtattatttatgacgcagtctataaatttagatgacatgaatgattgaggctatttgttgttttaaaaggcttaaaaacacataggtaagataaattgatcaatagtgaatttaaaatattaagaaacatagtagcatctacctctgaaaattgcatcatatctaaattgacaatatgctaaacagttgttaaacaaaattcccacattatataaactttttagaccatacatgaatacataatcctccaagttcattttacagaaatggaaaaaggaaaaaagccacttgtagacaaaacagaggaaagacagcagaataaacaaatgtataggccaatctcactaatgaacacaaacgttatgtattctaattaaaatattagcaaataaattcctacagagccagaaaataataatatatcatcactaagtgtgatctgttcaagaaatgcagggtttgttcagcactagaaaatctaccaagtgaatttactacattaaatacctacatgggagaaaaaaataagattatattcaaaagctgttttataaaatgtatcaccaaatcctgattttaaaaattaagaagtaaaacttttaccatactagaaatagaatggaacttccttgatagctatcagaaaactatagagcaagcatctcattgagtaaacattggaaatactctctttaaaatcagtaacgagaaaaaagtacttactatcacattgttaataagcattgtatacagcccctaatcaattcaccaagtcaagaaataaaaaattgtacaaatattggaaacaagtaataagaaataaattgtatactttatttgttggaaaggataaagaaaatcccattacttttagaaaacagcaaagatgaaattttctatgctttattgcatgctagcaatgatagaacatataatagatgataagatctgcttcacagtagccacaaaactataaaatgcataaagatgacccaaataaaaatatgtataaagcctataggaaaaaaactataaaattttacagaaggacataaaagaagatttgaataaaatgtgaactcagccgtaatcagaataggatggctcaatattgtaaagttaagaatactcccccaaattaatctgtaaatctaccacaatgtagtaaaaaattctattaatattattcatgaaactcaaaatgcttcttataaatttcatttagaaggggaaacatgccaagagaagtttgtataagacaaatggggaaggaagagagagatttgcctactatattttaaaacttataaaaatataataattaagaaaatgtaatattggtataaaaatagaaaaagagatcctggttcaacaacaaacccatgggaatttagtgcatggaagagtagaattttgaattgttgagaaaaggatgcactagcaacaaacagtgctggataaattgtctaccaataagaagaaagaaaattaaattcttaccttccataatttacaaaaataaattcaattatatataaatttcaaaatgtaagaaacaaagttacgaatatattagaagaaaatatagaaatataagaacacattgttgtgatttaatgttaaaataggaaaggtcttctcaaagaagacataaatacatgtgtataaatataaaatatcacacaaatgtcataagaaatgaatcaataagtttaactatgtgatatttaaatcattctaccataaaagacgttaaaccatgttaaaggcaacagtagtagaggaaataatatttgtaaaaatatatacatatttttgtataagtatctttgggtgattatgtgtgtggggggtacatatacaaatgtatgtttatacgtaatgtatatgtttactgtttaaatacaggtcatgtatattcatcttgtgtgcgtatatatatttatgcacatataaatcaatcaaaactacaaaaaatccaaaagaataatgggtaaaagatttgaacagacaaatcaaagagttagaaaaacaaacaaaagatatttaactttggccgggcgtggtggctcacgcctgtaatcccagcactttgggaggccgaggcgggtggatcacgaggtcaggagacagagaccatcctggctaacacggtgaaaccctgtctctactaaaaatacaaaaaattagccagacgtggtgacacacccctgtagtcccagctactcgggaggctgaggcaggagaatcccttgaacccaggaggtgaaggatgcagtgagccgacatcacgccactgcactccagcctgggcgacagagtaagattctgtcaaaaaataaaagaaaaggaaaggaagggaggggaggggaagggaggggaagggagggatgagaggggaagtgaagagaggggaggggaggggaggggaggggagagaagggaagggaagggaagggaagggaagggaaaaaaatacttccctacaagcagaaaaatgtaaatgaaaataacagagatgacacatccattatatttcctactaaatgggcaaaaattaaaagtttaatatcacattttaccatagatatgaggaaagttctatctaagggatctcctttggcaatatattaaaactttaaatatacgtaactttttactgcaatttcatttcttacggagtattacagatatcccacatttacccaagtgaacatggaagcatggatgtgacacaacgaacagaaaataatactgcagtttaacaggaaggaaagttttccaaacatattacattaacaaataagtttgtagaacaatatatacagaacctctgatttttataagaatgtatgtatatatacatttatgtaaatatgcagccatgtaatgtaccccttttctctatcactcttgtcaatttagcctgaaatatattcctcatcacatgttcctttgagatttttatctttctatttgcttactatccaatgactctctcttctgaccagaatataggttccatgacagcaggatttatattaatttcatcactgatatcccctcagtacctggaatagcagttgactcataagaggcccagcaagggtttttcaaataaatgcaaaaagttatatggcattaattaactaattgattacacagctggtgagcaattaggattggtgacactgtaatgaaatatttgtggttatgctcaataaaaccccaatgtctattaacatgcacttatacttttaaccatatatttacagattagaatatatgaatactcattacacgctctttgggcactagaacttgtagtagcctttagaataaacaatgtatctatccatgcttggtaagtacatttttttttttttcaaaacagcttattgggaaagaacacagctgaaacaagtgtttagaattaccaaaaagcaaaaaggtgattttttttcctaacaaaatgaaaattctggcaagtgtataagatgaaaaaatcattttgttttacatactaagagaattgtactttttgaaagtcatcaagcataaggaagttaatatcaaattaagaacaaatgtatcattggtccctacagaagaaatacagtatgtattgatgacaagtatgttataactttggtggggtggagggaaggatttctaaaaaggattcaaagaattaacacattttttatgattccaagataagactttgcactttttttacttactgccatatatgtggattttgttgatctaaaataatcaacacacatctttgttgaaatattatctattattctctaaaactgttcataattatccagaataagtgatagtttgtgtttttgcatgtattactgactcttccaaaaagacatgtctcttagatttcactagtattttaggtaatagctttaaggaatatgttacattctatatttcagtttcttagaaatgatgttaggtacatagcacttaccctgactataaggatttgtcgccatttgattattttgaggccaagcattcagaatagcacaccatgcatgccatgcaccccttcttttatttaactacatttaaaggattcttaccatttttttcactttttgaaattataactacttagtagaatgtctttattgcataaatctctgtaatctttcctgggactcctgaaatgcactgatgtcatctcctcaaataaagcagttaatgagatggcaaatcttgcttgctgattgctgtttttgtttattcttcaaataatttttaaatactttgttcaccacttcttaagggatagtgttgattatgttcttcaataagcaatgcttttattcttgctttctaaaagtgatacagatgagctttgttttaatctcattattatgcccctgtaaaacaattatttagagactaagaagaagtaatctgaaaggaattgtgatattttccaaaccttggaatttcttgtgtttattgtagtaattatagctatcatttattgtgtggttactatgtaccacatattgtgataaaaaacttgcatttcttgtgtttacagcaatcctaaggtaactattattaaatattgctacccctattttgtagatgaagaaatgaggtacagagaggttaactgactctcctatggaattacagccagctagaggtggaatcaagatgttatccaattctatgatagaattgtaacagtattgctcaaaagaagagtgtttctgtggcaaattagcttgaagaaagtgtggaaattctatgtctgggtggaggtttgagcagattatgatcttttaaaactagggaggaacttgtcagttcacactgaactctaccatcgtttttgtataatcagctgttgagttttactttctttagcttagagatgcacaaaacttcccaaagatggtaatcacttctagctatgagtcatttctctcaccttctgcaggaactaaagaaactcttgtcataattgcttgtcataatttcttgccattcataaaaagccaataatgcatttttgttttacttaatacattttactttacagtttataaagcacaagcagtgtgcaaaatgcagggaatgcttaggtacgaggtctagcaccgccctcaaagtagttcacaatcaagtggagaagaaagacctatgcacaaataatgcagaagaataaacaaagtcaaggtgaatttcagtcaagtggagggtgtgtgtgtgtgtgtgtgtgtgacaagaacagcaaagggatgaagagtataagattagtatggattcatcaccagctcactttcaaataagaacagcaacgatttgcatggtgaagaaggaggcattttagctcaagtctgaagtccttgactaaggttatagcagaagatgactttgggtgtgggttaagctgggtgtgggttaggctttgggtgtgggttagggtgtaccactttatattttctgatttagaatgttctctgcctatatgaatacattataaaagctacaggaaggagtcacatacatatcacattctactatgaaaatagtctcataaatccataattttaggtaattttccaaatattttacagtgatatttcttagtgactgaagcataaggagtgcaatgcatgcttgaggtaggagtatatgagccttaagtgggaagacatctggagatgaatgtaatctgtattggttttgatgttttaaatctgtttgccactacacatctgtaatgtaatataataaatataataaaacttctatgtgaaccatgtctctccaggatatgataaagatttaaaatggaagaacttatcctttagaggagttagaaaaccacaagattttgcaatgtacttttcaatgataggaaagtattttatagtcacaaaatcatagagtgatgtcattgttgctaggtgtctcccttcgaaattttgaccgaataacctattcatctctgtcccagctatgtgcttgatttgtgttttgcacattgaaataacatgcactaaactgaccatcataactggtgatttggaaattctgtgtgtgtgtgtgtatatatatatatatatatatatatatatatacacacatacacacacacagaagatgtgtgtgtgtgtgtgtatggttgtatgtatgtctatgctatacatatatatgtatgtatgtatacacatacatatatatgtatacacatacatatatatgcatacacatacatatatatgtatacacatacatatatatatatagcatagacatacgtacacccatacacacacacacacacacacacacacatcttctaacaagtacacattattactagaggtgatctcatctaaaagaaaaagccatggaatgaacgtaagactttagacagatattcctgatatatgtgcaaaaacatggcacttaaaattatgttagtggattaatcaccagttttgtaaagtttaataccaaatgacagggaaaacagcaccgggtttggcaggcagatggagaatgaaccgttacgtctcatccatctccaattcctatgattatatgattaaatattagtgtccagagacgagcaagggaaatgccagcccttgaaataccaagtgtaggccagaaaagactgaataaatacttcactgagacaaatccagaagatgaataaagtggccaaaaactggggtaggagagggctctttcccaggtagctaattagaaatgtctcaggaacttgagttgaatgaattggaagaaaaagtttactcaggaaaaataattttgaaatacaattcaatagcaagaagtggtttttttgaacaaatattattttctgccacttacattttatttattactatgctgacacaaagtagatgaaagaataatggatagataagcaaaaagtctccttctaagggactttacaagagtattacaaaattatagactccatcccacccgatagtgaaaaattatttatagcagtcttctcaaaggaagagacagatagaggacaagaataatatggaagcttcgtcaaactatatgtagcttctgtccaaaatgttaatacacatctcagtggcaaggagtgttttcccttctctttttcattttgagaacctgtatcgtaaatatactagcatgctggatacctcagcaaatgcaaactctcactcagcatttcccctatctcagggactatgtatggcaatttatatatgaggttaatgcctgcattagcactagaaagtaggtaatataattaacccaattttacagtcacagtaactgatgcttacacagcttaaagaatctgaccaagataacaggtttagaaagttgtagagaaactaggactagaaccattgtcattctgacttcaaagtctatgcttttatccattatctattaaactatactaagtgttgatggaggagaaacaaaaatagaaattgaactgaaaaatttaaaaagtgttaatttacagccccccccaacacacactcattgtattgtaaaatttttgaactttatattttcctgatgccacaatatccccacaaacaggctgtgaggtgacctagtgactttcaaacacagcaatgaaatcccctcatattttttgctcctccatcctaacccctaatgaaggcacttggcttccaggcatcactctctgcacccccacctgcttggttgatccctctgcttgggagctgctcccatatggccctgcatggcttgctttgcctcctgtccctatgacctgtgagtaaataaattctttaattgaatatgcctctctgagtgcaatttcctcaggtgtgctggaatgatcttttttaaaatttacttatttatttatttagaaacagggcattgctctgttgcccaggctggagtgtggtggcatgatcatggctcactgcaaccttgacctcccggattcaagcaatccttccacttcagcctcccaaagtgctaggattacaggtatgagtcatcatgcctgacctggaataattttcaaagagcgcagaagggggacctatatatatgtaatttcatatgttttatatatttgtagtatatgtataattacattatatttatatattttatatattatatgtaaatataaatagaatttttattcaagttcataagaaacatggcctctttctaaatattgttatttatttacatatgcctccacaacaatactcccagaataaatgtatagatgaatgctaatgtttttatcggatttaaattccaatgcctctatttggagctagacctagataaaaggaagtcagttacatgtttaaggcacaaaattttaattatcttaaactttgtagaaataaatttttagaaatttataaaatcatagaaaaagttgacaattttcttattactattaccaagaactgatgatgctttacatcgtaagatacttgctttaatattccattgtaagaagtggggaagttccttcatttttgtttccataccttttatgtatttcttgcctctctaagagataaaaatattaatactatcatacttttcctcatcttcccttactctaactccattttttttattagtgttaaaattatgatgttgatttcacattatacatgtttatagcctttatattgcgttctataaaaatccttctcagagtcatttgttgttatttctatatttaaataaatccaaatgctaattgcaagcgagtttatcatggtgtctttattgttgagcttttgtcttgatttaccacctaactgattggatttgttgtccagcaggttgactctttccaaaaaagactgttacaacgtttcctgaatattttgtattggagaatttctgcctactgtctggtttttttttttttttttttttaagacggagtctcactctgtcatccaggctggagtgcaaaggcatgagatcggctcactgcaaccccgcctcctgggttcaagcgattctcctgcctcagcctaccaggtagctgggattacacatgtgtgccccatgcccagctgatttttttttttttttttgtatttttagtaaaaacgggggtttcaccatgttggcaaggctggccttgaactactgacctcaagtgatcagcctgcctcagcctcccaaagtgctgggattacacacgagagccactgtgccttgcttctgtttactgtctttatatttgactgacatcttaatcagatataatattcatagttaaaatgctcttttgtcagaatttggtacactttttcttttttctagtgtggaatgaggttgtagaggagtgagaggccaccataagttttctctttaaggtgatcttttttttctgcttacatgggtaacaaaacaacatttttaaaaattattattatattttaggttctgggatatatgtgcagaacatgcaggtttattacataggtatacacgtgcgatggtggtatgctgcacccatcaacctgccatctacattatgtatttctcctaatgctatccctcccctaacctcccaccccctgacaggccccagtgtgtgatgttctcctccttgtgcccatgtgttctcattgttcaactcccacttatgagtgagaacacacggtgttaggttttttgatcctgtgttagtttgctgagaatgacagtttccagcttcatccatgtccctgcaaaggacatgaactcatccttttttatggctgaatagtattccatgctctatatgtgacacattttctttatccagtctatcattgatgggcctttggattggttccaagtctttgctattttgaacagtgcagcaataaacatgcatgtgcatgtgtctttatagtagcatgatttataatccattgggtatatatacagtaatgggactgctgggtcaaatggtatttctggttctagatccttgaggaatagccacactgtcttccacaatggttgaactaatttacactcctaccaacagtgtaaaagcgttcctatttctccacctcctctccagccatctgttgtttcctgactttttaatgattgccattctaactggtgtgagatggtatctcattgtggttttgatttgcatttctctaatggccagtgatgatgagcttgttttcataagtttgttggctgcataaatgccttcttttgagacgtgtctgttcatattcttcacccacttgttgatggggtttttttccttgtaaatttgtttgagttctttgtagattctggatattagccattgtcagatgcataaattgcaaaaaatgttctcccattctgtaggttgcctgttcactccaatgacagtttctttcactgtgcagaagctctttagtttgattagatcccatttgtcaattctggcttttgttgccattgcttttggtgttttaatcatgaagtctttgcacatgcttatgtcctgaatggtattgcctaggttttcttctagggtttttatggttttaggtcttacatttaagtctgtaatctatcttgagttaatttttttatgaggtgtaaggaaggggtccagtttcagttttgtgcatatggctagctagttttgccaacaccatttattaaataaagaatcctttccccattgcttgtttttgtcaagtttatcaaagatcagatggttgtagatgtgtggcattatttctaaggcctctgttctgttcaattggtcgatatctgttatggtaccagtaccatactgttttggttactgtagccctgtagtatagtttgaagtcaggaagcatgatccttccagctttgttcttttcacttaggattgtcttggctatatgggctcttttttgtttccatatgaaatttaagtcattttttctaattctgagaagaaagtcaatggtagcttgatggggatagcattgattctacaaattactttgggcagtatggccattttcacaatattgattcttctatccataagcatggaattttttccatttgtttgtgtccactcttatttctttgagctgagatttgtagttctcctggaagaggcccttcccatcccttgtaagttgtattcctacgtatgttattctctttgtagctattgtgaatgagaattcactcatgatttggctctctgtttgtctattattggtgtagaggaacggttgtgatttttgcacactgattttgtatcctgagactttgtatcctgttgcatttttatttctgccttaattttgctatttatccagtagtcattgaaaaggttttcaatttccatgtagttgtgcagttttgagtgagtttcttagtcctgagttctaacttgattgcactgtggtctgaaagactgtttgttatgatttccattcttttgcatttgctgaggagtgttttacttccagttatgtggtcaattttagaatatgtgtgatgaagtgctgagaagaatgtacattatgttgatttggggtggagagttctgtaggtatctattagatctgcttggcccagagctgagttcaagtcctgaatatccttgttaattttctgtctcattgatctgtctaatactgacagtggggtgctaaagtctcccactgttattgtatgggagtctaagtctctttgtaggtctctaagaacttgctttctgaacctgggggctcctgtattgggtgcatatatatttaggatagttagttcttcttgttgcatcgatccctttaccattacgtaatgtcctcctttgtctcttttgatctatgttggtttaaagtctgtttttatcggagaataggaatgcaaaccctgcttttattttgttttacatttgcttgataaatattcctctatcctattattttgagcatatgtgtgtctttgcacgtgagatgggtctcctgaatacagcactctgatgggtcttgaatatttatccaatttgccagtctgtgtcttttaattggggcatttagcccgtttacatttaaggttaatattgttatgtgtgaatttgatcctgtcattatgatgctagctggctaccttgcccattagttgatgcagttttttcatagtgtcaatggtctttacgatttggtatgtttttgcagtggcagatactggtttttcctttcatatttagtgtgtccttcaggagctcttgtaaggcaggcctggtggtgacaaaattcctcagcatttgtttgtaaaggattttatttctccttcacttgtgatgtgtaatttggctggatatgaaattctggattgaaaattattttctttaagaatgttgaagattggcccccactgtcttctggcttgtagggtttctgcagagagatctgctcttagtctgattggattccctttgtgggtaacccaatctttctctctatctgcacttaacattttctccttcatttcaaccttggtgaatctgacaaatatgtgtcttggggttgctcttgttgaggaatatcttactggtgttctctgtatttcctgaatttgaatgttggcctgtcttgttaggctggggatgttctcctggataatatactgaagtgtgttttccaacttggttccattctccccatcactttcaggtacaccaatcaatcataggtttggtcttttcacataatcccatatttcttgaaggctttgttctttctttttcattctttattccctaatcttgtcttcatgctttatttcattaagttgatctttaatctctgatatcctttcttccacttgatcgatttggctattgatacttgtgtatgcttcacaaagctctcgtgctgtgtttttcagctccatcaggtcatttatgttcttctctaaactggttattctagttagcaattcctctaaccttttttctaggttcttagcttccttgcacttggttaggacatactcctttagcttggaggagtttgttattatccaccttctgaagcctacttctgtcaattcatcaaactcattctccattcagttttgttcccttgctggtgaggagttgtgatcctttggaggagaagaggcattctggtttttggaattttcaggctttttccgctggtttttcctcatctttgtggatttctctacctctggtctttgatgttggtgaccttcagatggagtttttgtgtggtcatcctttttgttgatgttgatgctattgctttctgtttgttagttttccttataacagtcatgcacctcttctgcaggtctgctggagtttgttgaaggtccactccagaccgtatttgcctaggtatcaccagcagaggctgaagaacagcaaagattgctttctgccccttcctctggaaccttcgtcccagaggggcacctgccagatgccaactggagctctcctgtatgagatgtctgtcaacccagaatgtctcttctcctccaagtatcacaactcctcaccagcaagtgaacaaactagatggagcatgagtttgacaaattgacaaaagtaggcttcagaaggtgggtaataacaaattgctccaagcaaaagcaacatgttctaacccaatgcaaagaagctaagaacatcaaaaaaaggttagaggaattgctatctagaataagcagtttagagaagaacataaatgacctgatggaactgaaaaacacagcacgagaacttcgtgaagcatacacaagtatcaatagccaaattgatcaagtggaagatatcagagattgaagatcaatgtaatgaaataaagtgtgatgacaagattatagaaaaaagagtgaaaaggaacgaacaaagccttcaataaatataggactatgtgaaaagaccaaacctacgattaactggtgtacctgaaagtgacagggagattggaaccaagttggaaaacacacatcagaatattatccagaagacatctccaacccagcaacaggccaacattcaaattcaggaaatacagagaacaccatattcttcaaaaaaaaaatttcaacccagaacttcatatccagccaaactaagctttgaaagacaaaagaagggcattacataatggtaaagggatcaatgcaacaagaagaactaaccatcctaaatatatatgcaccgaatgcaggagcacccagattcagaaagcaagttcttagagacctacaaagacagctcttattattttgaaatatgtcccatcaatacctaatttattgagagtttttagcatgaagggttgttgaattttgtcaaaggccttttctgcatctattgagataatcatgtggtttttgtctttggctctgtttatatgctgcattacatttattgatttgcatatattgaaccagcattgcatcccagggaggaagcccacttgatcatggtggataagctttttgatgtgctgctggatttggtttgccagtattttattgaggatttttgcatcactgttcatcaaggatactggtctaaaattctcttttttggttgtgtctctgcccggctttggtatcagaatgatgctggcctcataaaatgagttagggaggattccctctttttctattgattggaatagtttcagaaggaatggtaccagttcctccttgtgcctctggtagaattcggctgtgaatccatctggtcctggactctttttggttggtaagctattgattattgccacaaattcagagcctgttattggtctattcagagattcaaattcttcctggtttagtcttgggagagtgtaagtgtcaaggaatttatccatttcttctagattttctagtttatttgcatagaggtgtttgtagtattctctgatggtagtttgtatttctgtgggatcagtggtgatatcccctttatcattttttattgcatctatttgattcttctctcttttcttctttattagtcttgctagtggtctatcaattttgttgatcttttcaaaaaaccagctcctggattcattattttttgaagggttttttgtgtctctatttccttcagttctgctctgattttagttatttcttgccttctgctagcttttgaatgtgtttgctcttgtttttctagttcttttaattgtgatgttggggtgtcagttttggatatttcctgctttctcttgtgggcatttagtgctacaaatttccctctacacactgctttgaatgcatcccagagattctggtatgttgtgtctttgttctcgttggtttcaaagaacatctttattcctgccttcatttcgttatgtacccagtagtcattcaggagcaggttgttcagtttccatgtagttgagcggttttgagagtgagattcttaatcctgagttctagtttgattgcactgcggtctgagagatagtttgttataagttctgatcttttacatttgctgaggagagctttacttccaactatgtggtcaattttggaataggtgtggtgtggtgctgaaaaaaatgtatattctgttgatttgtggtggagagttctgtagatgtctattaggtccgcttggtgcagagctgagttcaattcctgggtatccttgttgactttctgtctcgttgatctgtctaatgttgacagtgaggtgttaaagtctcccattattaatgtctgggagtctaagtctctttgtaggtcactcaggacttgctttatgaatcttagtgctcatgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggctcagtagatcttcctccatccttttattttgagcctatgtgtgtctccgcacgtgagacgggtttcctgaatacagcacgctgatgggtcttgacactttatccaatttgccagtctgtgtcttttaattggagcatttagtccatttacatttaaagttaatagtgttatgtgtgaatttgatcctgtcattatgatgttagctggttattttgctcgttagttgatgcagtttcttcctagtctcgatggtcgttacattttggcatgattttgcagcggctggtactggttgttcctttccatgtttagcgcttccttcaggagctcttttacaaacccacagccaatatcatactgaatgcgcaaaaactcgaagcattccctttgaaaactcgcacaagacagggatgccctctctcaccactcctattcaacatagtgttggaagttctggccagggcaattaggcaggagaaggaaataaagggtattcagttaggaagaggaagtcaaattgtccctgtttgcagatgacatgattgtatatctagaaaaccctattgtctcagcccaaaatctccttaagctgataagcaacttcagcaaagtctcaggatacaaaatcaatgtgcaaaaatcacaagcattcctatacaccaacaacagacaaacagacagccaaatcatgagtgaactcccattcacaattccttcaaagagaataaaatacctaggaatccaacttacaagggatgtgaaggacctcttcaaggagaactacaaaccactgcttaaggaaataaaagaggatacaaacaaatggaagaacattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagccctcatcgccaagtcaatactaagccaaaagaacaaagctggaggcatcacactacctgacttcaaactatactacaaggctacagtaaccaaaacagcatggtactggtgccaaagcagagatctagatcaatggcacagaacagagccctcagaaataacgccgcatatctacagctatctgatctttgacaaacctgacaaaaacaagcaatggggaaaggattccctatttaataaatggtgctgggaaaactggctacccatatgtagaaagctgaaactggatcccttccttacaccttatacaaaaatcaattcaacatggattaaagacttaaatgttagacctaaaaccataaaaaccctaaaagaaaacctaggcattaccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaatctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtccttagtagggacacggatgaaactggaaatcatcattctcagtaaactatcgcaagaacaaaaaaccaaacaccgcatattctcactcataggtgggaattgaacaatgagatcacatggacacagaaaggggaacatcacactctggggactgttgtggggtgaggggaggggggagggatagcactgggagatatacctaatgctagatgacgagttagtgggcgcagcacaccagcatggcacatgtataagtatgtaactaacctgcacaatgtgcacatgtaccctaaaacttaaagtataataataaaaaataaataaataaataaaaaagaaaaaaaaagagacctacaaagagacttagactcccaaataataatagtgggaaactttaacactccactgtcaatattagacagatcaatgagacagaaaattaacaaggatattcaggacttgaactcagctctgagccaagcagatctgatagacatctacagaactctccaccccaaatcaacattatatacattcttctcagcaccacatcgcacttattctaaagctgaccaagtaattagaagtagaacactcctcagcaaattcagaaaaatggaaatcataacagtctctcagaccacagtgcaatcaaattagaactcaggattaagaaactcactcaaaaccgcacaactgcatggaaactgaacagcctgctcctgaatgactactgggtagaaggcagaagtaaggattttctttgaaactaatgagaagaaagacacaatgtaacagaatctctgggacacagctaaagcagtgtttacagggaaatttataatactgaatgcccacaggagacagcaggaaaatctaaaatcgagacccaaacaccaccattaactacagaagcaagagaaaacaaattcaaaagctagcaggggcaagaaataactaagatcagggcaaaactgaaggaagtagagacacgaaaaacacttcaaaaaatcaatttatccaggagctggttttttgaaaagattaacaaaagagcccactagctagactaataaagaagaaaagagagaagaatgaaatagacccaacaaaaaatgatataggggatatcagcactgatcccacagaaatactaactaccatcagagaatactataaacctctgcacaaatgaactagaaaatctagaataaatagataaattcctggacacatacaccctcccaagactaaaccaggaagaagtttaatccctgaataaaccaataacaagttctgaaattgaggcagtaattagtagcctaccaaccaaaaaaaaataaaaataaaagcccaggacctgacagattcacagccaaactctaccagaggtgcaaagaggagctggtaccattctttctgaagctatttcaaacaagagaaaaagaatgactcctctctaactcattttatgaggccagcatcatcctgataccaaaacctggcagagacacaacaaacaaagaaaatttcaggccagtatccctgatgaacattgatgtgaaaatcctcaataaaatactggtaaacagaatccagcagcacatcaaaaagcttatccaccatgatcaagtgggcttcatctctgggatgcaaagctggttcaacatacgcaaatcaataaacataatccatcacataaacagaaccaaggacaaaacctcatgattatctcaatagatgcggaaaagacctttgacaaaattcaacagcccttcatgctaaaaactctcaataaactaggtattgatgaaatgtatctcaaaataataagagctatttatgacaaacccacagccaatatcatactgaatgggcaaaagctggaagcattccctttgaaaactgggacaagacaagaatgccctctctcaccactcctattcaacacagtattggaagttctggccagggcaatcaggcaagagaaagaaataaaaggtattcaaataggaaggcaggaagtcaaattgtctctgtttgcagatgacatgaatgtatatttagaaaaccttatcacctcagcccaaaatctccttaatctgataagcaacttcagcaaagtgtcagagtacaaaatcaatgtgcaaaaatcacaagcattcttatacaccagtaatagacaaacagagagccaaatcatgattgaactcccattcacaattgctacaaagagaataaaatatctaggaatataactcacaagggatgtgaaggacctcttcacagagaactacaaaccactgctcaaggaaataagagaggacataaacaaaaggaaacacattccatgctcatagataggaagaatcaatatcgtgaaaatggccatactgcccaaagtcatttatagcttcaatgctatcccatcaagctatcactgactttcttcacagaattagaaaaaactactttaaatttcatactgaaccaaaaaaaaagcccgtatagccaagacaatcgtaagccaaaagaacagaacagcatatttttaaactggctgttgataattttgcttctgtagtcgcctatggctaatttttttcttatttttaatagttttgtacttcactattataaacagcatgttatgaagatctttgcacatgcatactattatacataattgaatataaatttaaagttaattttagaagtcttattacctgaatagtgcacatgcattacaaatatttacaaatattacaagttgccttctataggggtatcattgtcaactcccattatcaatgtataattgtacatgttgccccaccccaataaatacagtgtattaatttttcagcattatagatttgctgagtaaaatgtagtatcttatttaattttcatttttcttattacgagtgaagtttagcccctgtttatatttaagggtgttttacattcttttttcagtttgagtttcatactctttacccatttttattgaatattttctatttgatatgtaggtattactaatatattaagaaaattaatactcccaatgcttgcaatttctcataaaaatattttcccagtttatcagttgtctgccagctttctgcatagcattttgtgatgcaaatatttaatttttatatccaattttatcaaacatttttatggctgctgggattctgtcatggctaagaaaactgttttccattccaatattataaccttttcccattttttcttttaggtatgtttatggtttcatgtgagaccttagacaagttacctaacatttctgtgctcaaatgtccttattgatagtggggacagtatcaacaatacattcctcatagaattctgtggtttaagttacttcataaaaggaaaataaacaattattagccagacgtggtgactcaggcctgtaatcccaacactttgggagggtgaggcaggaggactgcttacagccagaagtttgagatcagcctggtcaacaaaagtgagaccttgtctctacattaaaaaataaattagccaggtgtgatgttgtgcacctgtaattccagttattcaaaaggaaggggaaggagaacagaactctctcttcaaatcttcaaaaaatagttaaaaacgaaatttaaaaacttgcacactgtgagaacttaaaaagggatagctatcttactgttattgaataatcctgttttcatcactggtatgcacaacgtcatctttatcatatactaaatttttaaaactatttagctccatttctacatgtttcacgtgacgaaatcagtggtgtttctccaagctcctatattatcttcctattatggccctgattatattattttgtatctattgtttgtctagattgttatcattggactacaaattatttgaggaggaagattttattgttttctttgcacacccactgcctacaaactaacatagtaaatttacagtaaatattttttaaaaattcaggtctataaaggcatctgtaattgaattcacccaaaatatttcaattcgacgtagccaaatttatcaaattctctctttgatttttcccttctgtgtcctaagaaatcttcgcataagccaaggtcacagagatttttttcctttgtattttctagacattttgttattttatctaatgtttaagtctatgacacatttcaatttatacttggtatgcggttaagagtgaaggctgaggttcattttattttgtgtatattgttcttcaattattctagcaccactttttaaaagacaatcctttccctaatgaattaccttatggcaaataaactatgcatcattagacttacatatttcagatctttgtacctttttgtaaaccatttgacagtacattcaaatggaatgatttttaaatggagataatttttttttttttttttttttttttttttttttttttttggtgagacggagtcttgctctgtcgcccaggctggagtgcggtggcgcgatctcggctcaccccaagttctcctcccgggttcacgccattctcctgcctcagcctcccgagtagctgggactacaggggcccaccaccacgcctggctaatttttttttttttttttttgtattttcagtagagaccaggtttcaccgtgtcagccaggatggtctcaatctcctgacctcgtgatccgcccacatcgtcctcccaaagtgctgggattacaggcgggagccaatattttttaaattaacctcaatgttttcattattttctcattgtcttttcagttattttaattcaactttttttttatttgataatgattcataggccggcagtaagatgtaacaaaaaagaaaacacattgaaatcagaaagtcttaggttcaaatgcccactgtgccatttactacctgtttgtgggttatttatataataacctgtaacctcagtttctttaattataaaatgtagataatttctatttcctaaggttatatggaagattacttaaaattactaatgtggggatggggtttacttactaagcatacatactcaattacattataggattctaataaaagaaatcctgccatggcttgtatgcatttttttccaccaagattaggcactgatccagcctacacttttcttacttatttaaagacactagcaatgagaacttgcaatttctctgttcttatattgctttacttttgccttgtccctcaccgaaatgatgattgatataattttggtgtctgtgtactgtaacttctgttgtttcgcatagaaacaaaacaatagagatatcttcagacataaaataattaggtaccctacatctttttgcaaagtttttaatatataaggatagaaccatgccaaaaagaccaagagtaaagttacaaaaaataaaaagacagattacatcatatttctccagattccattgctggcattcaggaggtaaggtttctatattgttgggggcacagttagaaagcaaataggtggtcctgggacctactgtgagttagctaccctgaaagtttaagtgctctggggtctgggtggctacacattgatcagttgaatgaattaaaataggtataaaactcttgggcccaggcacatttgctcctacttgtctgatcataacacacagaaagagggtatgttctcatcatcatttcaaagtgactaaacactatgaaagcactaggaaaatcaggatggtggagaccacagaaaatttcttgaacaaggaggcttaaagccagtgattgtgaaatctgagcttaatgggcctatatcagttactttttccctggcaagtagggaaggcaatcaggattacttcagaaagaaaacgatgatttatgcattcataaccatgggaattgtcacaaattttggtagaggcaaaatactggattgctgcttggtcttcaatgaaattatattatccaagccctctaaacagttaagctacatgagaagaggaaatggcttttaattaataatcagtattttctacataaagcatacttgagccaaactttcataataggtctggggtaatctgtcaaaaatattttaaaagagcccatgttgatttttaagagaatggcaacattcttatgatcaagtataatccataggaatacctataagagaaaaatgtatagggatgagacatttggaactattatttaaaataataaattattatgacaattttttgaagataattgtaatttcatatacattggaaagaaataatacaaagtgatcccatggaccatacccctatgataacagcactcaccaaagtagaaatagaagaaaaactcctcaatctgataaaagccatctcaaacaccagctgacatcatgcttactagcgaaagactgaaagtcttcccaccttagacttggaacaaagcaaagatgtgtgttctcaccattcttaaagataggactagaagttctaaccacttgcaatgaggcaataatagaataaaaagcaatcaaattggaaaataagtagtaaaactgtttctattcccagataacatgatctttttaatataggaaatccttaggatacacacacacagacagaaaaagagagagagaacacaaataaatgatttcaacaagattgcaagatataagatcaatatataaaaatcaatggtaattctatactagcaatgaacaatttgaaaataaaattaagaaaacaattctttttttatagtataaaaaagaacaaaacacttagaaattcaacaaaagaagtgcaaacttatgctctcaaaactataaaacatagctgacagaaattaaaaatctaaatagttggaaaaacatttcatgttcgtgaatcagaagactaaacagctgatagtagtatttcccacagtagttctacagattcaatgcaattcccatcacaatcccagctgacttctccatagaaattaacaaagtaattctaaattcacatgaattgcaacaggccagaacagccaaaacaatcttgaaaaagaacaaaacaagaagagtcagacttcttggtttcaaaacctactacaaagaaatattcatcaagacaatgtggtactggcatacgatagacatatagatcaaaggaatagaactgagagattcagagtccaaaaataaactttcatatacatggtcaagtgattttcaccaagattactaagaccctccattcactaggaacaggatagtcttctcagcaagtggtgctgggacaactacatagctaatgtaaatgaatgaagttggaccactacctcctaccgtatgtaaaattaacttgaaatggaacaaagacctaaatgtaagagctaaaacaataaaacactttgaagaaaaaatagaaatctgacagaccttggatcaattaattagtttattacctatgacgataaaagcacaagcaacaaaagaaaaaaataaattatactccatcaaactttaaattatttgtgctgaaaaaaatagcattaataaaatgaaaagaaaacccagagaatgagagaaaattttgcaaatcatatctctgataaaggactcatatccagaatatgtaaagaactcttccaactcaacaataaaagacaagccaactgtaaagcagggaaatagtttgaacagccatttcttcaaagatgtggacagtaagcaaatgaaaagatttgcaacatcatgagtcattagggaaatgtaagccaaaacaacaatgagataccccttgaaaaataaaaagggttggcaagaattcgaatatgttggaaccctaatgcattgctggtgaaaacgtaaatgagtgaaaccaatttgaaaagcaatttggcattcatcgaaagttaaacatagagttaccatacgacctagcaactctacttctaggtatgtaagagaattgaaaatgctatgtccacacaaaaacttccatgtgaatgctcatgcaacatttttctaagtggttaaaaaagtgaaaacaactcaaatgttcatccattgataagtagataaaaaagtatgatcacatattccatagcagccatgaaaagaaatcaaatactgatacattctattgatacaacatagatgaatgtaaaaaatatgctaagtgataacattcagacacaaaaggtcacatattttacaattccatttatatgaactatccagaatatgcaaatctataaagatagaaagtagatgaatggttgccagggattgggaagtgtgaagaatatatagtgattactaatgagtatggttttgatttgttttgtttcgtttctttaaggccaaaaaagttctcaaatagattgtggtgatggttgcgcaaccctgtgaatatacaaagaaaagtaaattgttcatgttaaaaaggtgtatcctatggcatgtgaattatatcccaataaagctgttattaaagaaatgaagtagtaataagtggtaatagaattaattagtatgtttcgagttaagcatatttgtatgggaagatatattttcaataaacatgtggctttattttatccagtggttttcaatatcttctttatactctacattatttacatatacaacaaacttgtgtaatatttgttacattctattaattgtgaaacactgatttagtttgctttataccacaaataaagctagaaaattatcttgaaaatattatgcagaagtagattttactacaaatggctagataattgaagcatattttatctataaatataagaataattttatttttctacttgatcctgcatctgtatttaatgcaatttttataaaatcctgaaaattgaagaattaaatatggtgacaagacacgattttgttgaagggaaaaatctctctcagattaaatagtacattttaaaatatgaatgcagctggatgcagtggctcacccctgtaatcccagcaccttgggaggctgaagtgggcagatcacctgaagtcaggagttcaaaaccagtctggccaacatggtaaaacctcatctctaccaaaaattcaaaaattagcagaacatggtggcaggtgcctgtaatcccaggaactcgggaggctgaggcagaagaatcgcttgaacccatgaggcagaggttgcagtgagccaagatcgtgccactgtactccagcttggatgacaagggcaagactgtgtctcaaaaaaaaaaaaagtaaaatagaataataaaatataaattcattctacacatatagaagttcctctatgaacatttaggttctaaaaatatgtgggtatgtgttgtccctatgcccattaaggcatataaaagctatagacataggcatattcatgaagttaaatttcttaaatgaatgaattttgatggcattgaatttgttttgttttctcttttaattgtaataataaagcttggcttagcagcttcaacaatctcacagattttgcacttattaggaaagataaaattggtagtcataaattattatacatttggtacaaatgcagcaatcatgctacagactgataaaagcaggaagaccaacattacaatgatacacacaactactgacaccatctctggtgtcaggaagagttgacttgctttagctatggaggggcaattacatatataattttattttcctatagagcttcaaagtacacaaaattctgtagaccttttcataccatagttatatattgtgccaaaaatgtgctagtcagtaaaaaatgaaaaatcaaactttccaattgagtcatatactaaatttgtctttgtcaattgatgtttattctacagagatttatttagaatggaatattccaatctgctaaaacaatttcttatttctgttgtgtgtgtatctgtggtaaaaatcaaagcttagtgtgtctgcatgcagccaaaagctgccattgtgacagcttgtctttcattttgtaacattcaaccacttattgtacaccagctgattttgttatcctgacctgcctgaggagtggatattactccttagtccaaatgcattctacaccatggagcctcaactggcactataaacttaattaaatactgtcattgaaaccagctgtaaactaagtaataaaagcatttttatttttctagctggagcccagaaaatctgacaaattttggatcagagtaatagacatattttgggcatgcctgtccacaaaatgtcactgttgaaggactggacttagagagcctgttcaaatctatgacccacctccctaactaccttcagccaactgggctgtggttttcacctgatctaagttaagctggtcagattcatctggggtgttgaaggacaatgggtagctgagctaataacactgaagattgaggggcttaggctgtgtttttatggtaagccataatggaccatgtccaaatagatgagggagagtaagaagcaattcgcacagagataaaaaataaaacagaaagaagaaaaggttgtgtggcatgaaaaaagatatgcgcagttttgagaattgggaaataaaaacaggcagtcttttgttttttcccaatgatgttttctgtacttgttgccctccataaatttctagatttctctgtatcctttatttaaaatatcactaggtggggttttttcagtccttgcaactcaaagctatttaaccagaatagtcaggaaaatagtgcattagagttagtatatttaaattaaaagtttcaaaagttctcctgttaaaagtttagacacatttcttttctttttaaatgaaaaactgcaatagcatctttttatctcagtagggaaacaccttctctctccttagaattcaagcaataacaattctgtggggtaatgattattctagatgcatggtaccatgtaaattaatctattgctttggctgcactgctccaaaaaacagtgctgatgctgagtgcacagaatgaaaaaattaattagccagactgcgaaatcaaataaatctcacagtggcgacctttgtgtagtagaataaggaaaagcattaagttcatgtaacaaccttggtagaagtaaaaccaagcttaaatagggccaagtgttcttataatttaaactggatcgtatagtccaggcccacaagaaagtcctggcagagaaaattgatcttaagggtctggtcaatagcaaactgttggtctttgactaaaatgcagtcttcttcattaatgttccaagaagaaaaacaacacagagaaaataaacacactgatttcttctcctgtacaaattatctccctgtactaggttaagccacagaacacgaggcagttagttcatcttgttgctctgagctttcaccgctgcagtttgtcttaggcctgcagctgatactcatcatctttcacctctacttctcattctagatttttctcacattccgcaggttctgttactgtgcaaggtgtctttgctaatggagtgacacggaacttcatcagcaaggggtctgagaccacagtcagcacagagttctcaggttgtggctgctttcctggtccatttaccattaaaattggccagcagagtaccaagagaagtacctaagtgtcaaacttcttcttccctgcaaaccacttaccctcacgtgtcataacagctctatttccttttcatggccacagtcaactacccctaccgttgtaatgattcctttgatgccctgagagttccttggtatgaggagcctaaatgaaaagatggcagacaaagctcaaacctcgtacttaaataggattctaaccctatctcttgtagaagaaacaagacctatagaagcacagaacctaagctcgtggagaagaaagcacttctgtctcccctctgggcccttaatgtcatgtattctacttaatgggcacagggtgatagaatctgtggaccccatggttatgtgtccactgccagagctactttgctgtaaaatgagtccatggctgtgtttgcattgctatgaaggaattggtccatttgcattgagcaaatggtaagccctcctaaggcgcttttccatgtgaggacttgtgtgaagaagccagcagacattctcaatccttcttttttttttcttttctttttattattattattattattattacactttaagttttagggtacatgtgcacaatgtgcaggttagttacatatatatacatgtgccatgctggtgtgctgcacccattaactcgtcatttagcattaggtatatctcctaatgctatcccttccccctccccccgccccacaacagtccccagagtgtgatgttccccttcctgtgtccatgtgttctcattgttcaattcccacctatgagtgagaacatgaggtgtttggttttttgttcttgcgatagtttactgagaatgatgatttccaatttcatccatgtccctacaaaggacatgaactcatcattttttatggccacatagtattccatagtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtacacacccagtaatgggatggctgagtcaaatagtatttctagttctagatccctgaggaatcgctacactgacttccacaagggttgaactagtttacagtcccaccaacagtgtaaaagtgttcctatttctccacatcctcttcagcaccttttgtttcctgactttttaatgattgccattctaactggtgtgagatggtatctcattgtggttttgatttgcatttctctgatggccagtgatggtgagcattttttcatgtgttttttagctgcataaatgtcttcttttgagaagtgtctgttcatgtccttcgcccactttttgatggggttgttttattcttgtaaatttgtttgagttcattgtagattctggatattagccctttctcagatgagtaggttgtgaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatgggtagccagttttcccagcaccatttattaaatagggaatcctttccccattgcttgtttttctcagctttctcaaagatcagatagctgtagatatgcggcgttatttctgagggctctgttctgttccattgatctagatctctgttttggtaccagtaccatgcgttttggttactgtagccttgtagtatagtttgaagtcaggtagtgtgatgcctccagctttgttcttttggcttagaattgacttggcgatgcgggctcttttttggttccatatgaactttaaagtagttttttccaattctgtgaagaaagtcatcggtagcttggtggggatggcattaaatctataaattaccttgggcagtatggccattttcatgatattgattcttcctacccatgagcatggaatgttcttccatttgtttgtatcctcttttatctcattgagcagtggtttgcagttctccttgaagaggtccttcacatcccttgtaagctggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaattggacttcctcttatcctaattgaataccctttatttccttctcctgcctaattgccctggccagaatttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccaacagtacctaatttattgaaagtttttagcatgaagggctgttgaattttgtcaaaggccttttctgcatctattgagataatcgtgatttttgtcattggttctgtttatatactggattacatttattgatttgcatatattgaaccagccttgcatcccagggatgaagcccacttgatcatggtggataagctttttgatgtgctgctggattcggtttgccagtattttattgaggatttttgcatcaatgttcatcaaggacattggtctaaaattctcttttttggttgtgtctctgcctggctttggtatcaggatgatgctgacctcataaaatgagctagggaagattccctctttttctgttgattggaatagtttcagaaggaatggtaccagttcatccttatgcctctggtagaattcggctgtgaatccatctggtcctggactctttttggttggtaagctattgattattgccacaaattcagagcctgttattggtctattcagagattcaacttcttcctgggttagtcttgggaaagggtatgtgtcgaggaatttatccatttcttctagattttctagtttatttgaatagaggtgtttgtagtattctctgatggtagtttgtatttctgtgggatcggtggtgacatcccctttttcattttttattgcgtctatttgattcttctctctttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgtttttctagttcttttaattgtgatgttggggtgtcagttttggatatttcctgctttctcttgtgggcatttagtgctatgaatttccctctacacactgctttgaatgtgtcccagagattctggtatgttgtgtctttgttctcattggtttcaaggaacatctttatttctgccttcgttacgttatgtacccagtagtcattcaggagcaggttgttcagtttccatgtagttgagcggttttgagtgagtttcttaatcctgagttctagtttgattgcactggggtctgagagatagttcgttataagttctgatcttttacatttgctgaggagagctttacttccaactatgtggtcaattttggaataggtgtggtgtggtgctgaaaaaaatgtatattctgttgatttgtggtggagagttctgtagatgtctattagtgcagagctgagttcaattcctgggtatccttgttaagtttctctctcgttgatctgtctaatgttgacagtggggtgtcatagacaacataacaccctagtgacaccagattttgttaaccatctctatagctcctcataggtcaggtctcctggtagtcactccaaccctttctaacctagccactcgtgaagataatttgcactaatgttacttccaccagataactactagtttggatttctataagccccttagcgactacataattctgttcagtaatagtgtctcctacagtcagccatgcctagagaggacatctaccaaagcgtctcattgatgctgctgctctatcagcaatgcattccttatcacattggtaaacagaatatgtaataggcttgtattcatttgggtttagattttttgttgctgctcagcatgtttttgagattcacctatgttgttgtatgcaacatatacaagtatttctttttctttttattgatgaacagtattccattctatgtaagtatcataatttgtatccattcacttgtttatgaactggtgggttatttccagttgtaaggtattaaaactaagcatctatgaatcctatatatatgtgtgtgtatatatacgtcttttgtgcgtacatgtttgcatttctcttaaggaaaccccaaggagtgttactgccggttcatatgacaagtggtacatatttaactttttataaaaataaaactggcaaacagtttttcaaataaattttactgttatacattctcagcagcaatgtatgaatactccaggaactgcatattctcaccagcacttggtactgtaggcctttttaattgtagtcattctcacgagtatgtggtcctatttcattttagttttcatataatttcctggatgattcatgatactgagcagagtttcatgtacttattggctatattttattttgtgaagtattttttcaaatttttgcccattgtggtggggacagtaatttttctattgagctgtaagggttgtttatgtattgtgaatataaaatatttgagatacgcacacatacacacagtacacacagatgtatatatgatttgctttatattttctacatgctgtcttttaaagtacagatgttgttaattttgaggatgtgaaacacatcgacttatcttttctaatttgtgtcctctgagaaaactctgcctaatccaaagtcacaaagattgtctcttataatttcttttagaagctgtagctttagattttacattcaggattataatccattttaaattcatctttgttcattgcctgaggtaagtgttgaagttcatttttccatatcaacacccagctgtctcataagcatttgttaaaaaatctattcttcactgcaccccaccctaccaatgcccctgccactgaaataccatgattactttttaggaactcaattgaacatatctgtgtggtctagtttgggacagactattctgttccttccatgtatgtgtctgtctaccttagatcttgattaccatagcataacagaaaatcttgaaatcacgtagcataaggcctctaactttgttctttttcaaaaaaattgaggtcactctagatcctttgcattccttgacaaatttcgtaatagtttctcaatttctcttccaaatataaagtctgttagaatattgactgaagttgtactgaaggtatagacccgttttggagaatatcttaataatattgaatcttccaacatagcgttatggtttatgtctctcttttaaaaaagatttcctttcatttctcacaacattttgtacttttaagtgtatagatcttatagattatattaaaattttctctaataagtgttttgtaatttttgagctatcaaaaatggcattagctaggagtggtggctcacatctgtaattccagcactttgggagtccgaggtgggtagaccacctgagcacagcctgggcaatacagtgatacctcatctctccacaaaaaataaacaaacaataggcatggcggcatgctcctgtagtcccagctactcaggaggattggctgagcccaggaggcagaggtttcagtgagctgagattgcaccactgcactccagcctgtatgacaaagtgagactctatctcaaaaacaaaacaaaacaaaacaaaaaacaagaaaagacaaaatatattttaagaaataaattataaaaaatgacaattgctatttaaatttagtttcctaaatatataaattatatataaaaatacaattgtttctatatcttgaccatgtatactgaaatgtttctaaattcacttattagttttaatggcttttcatattatggattccttttttgcataccaatcatgctgtctattaataaagttttacatcttctttccaacttgcttgcctatggaccccatccccaacccctcgcacccactaagtcatccagtaaaatgttgtatattaaagcagtgggaaaaggcatccttgtctttttcccagacttaaaaggaaaataatttagtctttcatcattaaactgtggtgatatgttagcctttattgcattgtggaagttttcttttatctctagttcactgaaagtttctatcataaatggatattgaattttatcaaaattctttactttgcttgttcctattgagatgattataccatttgtctttactctgtaaatatagtgaattacactgattgattttcaaatgttaaactcaatttgcagtcctggggcaaaccccacttggccattttataatattttctttatgtattaccggattatactttctaacattttgttaaatatttttgcatgtttattcttaagcaatattgatctgtagctttcttgtctttttctttctggcttttatataactgggaataacctgatttttatgtaaccagaaattattattcctcaatgatcccccttcatcatttaattcaaacaatttctttagaagaaagacatctttttgacatgagagaaattatttcatagtaatattagccctaaattttttgttccaacaaattttgagtttagagcataccttcattttaggattgtaacttagaaatgaaagatcaaaaaggtaggggaaggtgattattgactctttcctaatctgaatggttttttatctaagtgcttgaaatatttttactatgtgattatacacacacacacacacacactcgtattctcttgaatcttctccagttgatactgacattctgtgaaagaaaacagtactagctattgtgcccaagaggatatgagagagatttctttcctatccccttgtgacttgtaggaagtatagagaagcatctaaaatgcttactctcgcaaacagaatccagtaacttttacccatgattgattttcctttctctgttactgcagctccgagtgggacagacattggtataccagcactaggcagcgcagctgcggacacacagtgacaccgagtaatgtggcaggcctccttttaagtacatcaagtggaggcccagacagcaggggcacaatttaaatagagtcttcctgatgcaacacctttcagactctgaaagaggcccttttttaggaggtgtgacactcatattagataaggcaatcgtaactgtaaataaggcatactccagaggactgacaatgcttttcagaaatccaattacatgctcttatttggtgttagtgcaaacagaaaaataacaagccaacttatttcatccccaccgtgatttcctcaaggctaattaaagtgcactctgctgatgcctaaatcattcaactccaggcaatccaaagatttaaagggacaaacacccaatcaatgcgtggctgtcagtaagtggcattgtgtttggaaatgggcacaataaagtccttcattaacttgaatgctggaaactccctgtgaaaaaaaattggtctaacaaatttactgccatagatttatgaactagacttcatcactctgcataaagaactgataagtgatcaatgattcttcacaacatatggcataatcaatacgaatttggggaggagatagaaagacattaataatgcgtattttatgtacaggcctgttcctaaagattaagggcaccataaatcacacaggagctgagtaaagctagaataaaaataattactttagtaaatgtagtattcaaattttagaattagaaaaaatatctatattatcttgggtggctttaaaaagattttaaaatatttataaggtttttatttcatggtaaggttttgggggatgttgttggtagctttttcccccagtcattttgcttgtcactttattaataattccaaataatgacaaagaaatatatttgtatgtctaaattactcagaactattttcaggaaaaaacaatattagccatgccctagggcacactgttaggaccccttgattccattatcaagtaggtctgtttagctctctcctcgttcgttactgaaggtcaaaatttatgaatgagcccttctgtattaccataaaatgtgcactccagatttgtgccagagattaaaatcttaatctcataactcctcttcaaagcttagatctgaaaattagaacacctaactgatcggctgcccagcattcacttttcttacaacatatcctcacgaaggagcaaattcaaattgtgttactgtgtgtttcttgcagacctgaatgaggtttgatagtatgacatttgcttgtaatgaggaataatgcgtaacaatgttcactacatcacatagggtcttctctatgaaagctcatgggagaattttccatcattccagtagcaagaaaagttaattttctcctgaaaaaaaatggtttatatttgttgtaacaacactctatcacaacagaaacagtttttttacttttaaaagtaattttatattggttacatgttaaaataattgttgataccttgagctacataaaatcattatgaaaattaattttagctgtttcactttttaactttttaaatatgtcttctagaaaatttacagttacatatgtggtgggcttgcatgacttgcattgtttcttttcaacagtgatctagagaaagcttggtcatggctttttttttattatactttaagttttagggtacatgtgcacaatgtgcaggttagttacatatgtatacatgtgccatgttggtgtgctgcacccattaactcatcatttaacattaggtatatctcctaatgcaaatatggacttatagatcaaagccatgagttttagaagtgtgttttaacattatagtgttataacattaatatgatattgttatattataaaattataatactgtaatattatcaaattcttataatactgttatacataatttttagccatatcattattcaaatataaggttcgttgctgaagtgaattactaaagtccaccattcagagaccttcaatgagttttcagacttagaaaaaaaaagaccgtgcagtggttcacacctgtaatcccagcacattgagacattgagatgagagaatggcttgaacccagggattcaagaccagcctgggaaacatagtgagaaaccatctctacaacaaaataaaataaattagctgggtgtggaggcacacacctgtagcccctgctaattcaggtcagttaggtaaaaggattgcttgagcccagaagttgagagcttgaagctgcagtgagccatgattgtgccactgcactcacagggtgagacactttctcaaacaaacaaaaagggaaaaaaaaaaaagaaaagaaaaatgatcattagttgttacttcagagcttcgggtttaaaatagcatctagttagcaattatgcattcagattttccatacatttggctgaactatttattatactacatgaaaagagaaaatttaaaaccacctagaaaacatgattactgtataatatgattttttcatttctttggagtttttggatgtaattcaaaattatagtgttgccttacctgaactgttgaaattgaaagctaatccattatctcctccttcccgccaaccaacagccattaaaaaatagtacatctgtatctactaaaatacctagacattccattttgatgaaagagtgcttgtttttgaggaaacccaaaacctctctttctgtatgtggttaaagattgctatacctggaagaactatgtttcaattaaggcaaacagctaaggcttaatgcatcaggcaaaggatattccaacaaataaaaccaagtacacaagagtggagatagcctcactattcatgaattctggaacttaatctgtacagagcaatagagagtgaggcagaggatatatatcttaggtcattttctgctgctataacagaataccagagactgggtaatttataaacaatagaaatttatgttttcacagttctggaggctgggaagtccaaagtcaaggggccatacctggcgagggccttcttgctgcatcataatgtggcagaaggcatcagatgggtgagacagagagagggaaggggggtgaactcctccttttgtaaggaccccactattgtgataatgccatttatccactcatgagggcaaagccctcatgacccagtcacctcttatatgtcccactcctcaacactgttgcactggggattaagtttccaacaaatgaactttgggggacacattcaaaccacagcagtataggagaagatcaatcagaacagaattgggccaaaagatatggacaacagtctctgagaaggggcttcaaacagaatttgtgaaagagtgaggcaaatccatactcatcatttggcaaacactgagttttgatagatagagttttctgcattagacagtgaaaaaacaacaataacaagaatagtaaaattaacataacattttcatataaacagaaaggaaaatgaaagggcattctaataatccatattttaaaagagaaatctgaattaagaacccacaagaaagaattccaagagacaatttagtatgtgtttaaaaacagaagattgtttttgagacactccacatttttattagctttcattgcaagtaaaaagggagaattttatttgtttcatttgaaatttaattattggacgccaaacaggaacagctccagtctacagctcccagagtgagcgacgcagaagacgaatgatttctgcatttccaattgaggtaccaggtgcatctctctggggattgtcggacagtgggtacaggacagtgggtgcagtgcaccgagcctgagctgaaacatggcgaggcattgcctcaccagggaagtgcaagggggcagagaattccctttcctagccaaggaaaggggtgacagacagcacctggaaaaccaggtcactcccaccctaatactgtccttttctgacagtcttagcaaacggcacaccaggagattatatcccacacgtggctcggacggtcctacatccacggagcctcgctcattgctagcacagcagtctgagatcaaactgcaaggcagcagagaggctaggggaggggcacccgccattgccgaggcttgagtaaataaacaaagcggccaggaagctcaaacttggtggagcccaccacagctcaaggaggcctacctgcctctgtagactgcacctctggaggcagggcatagctgaacaaaaggcagcagaaacctctgcagacttaaatgtccctgtctgacagctttgaagagagtaatggttctcccagcaccgagtttgagatctgagaatggacagactgcctcctcaagtgggtccctgactccggagtagcctaactgggaggtaccccccagtagggggagactggcacctcacacggccgggtactcctctgagacaaaacttccagaggaacgataaggaaacaacatttgctgttcaccaatatctgctgttctgcagcctccgctgctgataaccaggcaaacagggtctggagtggacctctagcaaactccaacagacctgcagctgagggtcctgactgttagaaggaaaactgacaaacagaaagaacatccacaccaaaacccaatctgtacgtcaccatcatcaaagagaaatggtagataaaaccacaaagatggggaaaaaacagagcagaaaaactggaaactctaaaaatcagagcacctctcctcctccaaaggaatgcagctcctcaccagcaacagaacaaagctggacagagaatgactttgacgagttgagagaagaaggcttcagacaatcaaactaccccaagctaaaggaggaagtttgaacccatggcaaagaagttaaaaaccttgaaaaaagatcagatgaacggcgaactagaataaccaatgcagagaagtccttaaaggacctgatggagctgaaaaccaaggcacaagaactacgtgatgaatgcacaagcttcagtagcccatttgatcaactggaagaaagggtatcagtgatggaagatcaaatgaatgaaatgaagcatgaagagaagttcagaggaaaaagaataagaggaaatgaagaaagcctccaagaaatatgggactatgtgaaaagaccaaatttatgtctgattggtgtacctgaaagtgacggggagaatggaaccaagttggaaaacactctgcaggatattacccaggagaacttccccaatctagcaaggcaggccaacattcaaattcaggaaatacagagaacgccacaaagatactcctcaagaagagcaagtccaagacacataattgtcagatttaccaaagttgaaatgaaggaaaaaatgttaagggcagacacagagaaaggtccggttacccgcaaaggaaagcccaacagactaacagctgatctctcggcagaaactctacaagccagaagagagaggaggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctacaagagctcctgaaggaagcactaaacatggaaaggaacaaccagtaccagccactgcaaaaacatgccaaactgtaaagaccatcgaggctaggaaaaaactgcatcaactaatgagcaaaataaccagctagcaccataatgacaggatcaaattcacacataacaatattaaccttagatgtaaatgggctaaatgctccaattaaaggacacagactggcaaattggataaagagtcaagacccatcagtgtgctgtattcaggagacccatctcacatgcagggacacacataggctcaaaataaagggatggaggaagatctaccaagcaaatggaaaacaaaaaaaaacaggggttgcaatcctagtatctgataaaacaggctttaaaccaacaaagatcaaaagagacaaagaaggacattacataatggtaaagggatcaattcaacaagaagagctaactatcctaaatatatatgcacctaatacaggagcacccagattcataaagcaagtcctcagagacttacaaagagacttagactcccacacaataataatgggagactttaacaccccactgtcaacatcagacagatcaacgaggcagaaagttaacaaggatatccaggaattgaactcagctctgcagcaagcggacctgatagacatctacagaactctccaccccaaatcaacagaatatacattcttttcagcaccacaccacacctattccaaaattgaccacatagttggaagtaaagcattcctcagcaaatgtaaaagatcagaaattgtaacagtctcagaccacagtgcaatcaaactagaactcagggttaagaaactaactcaaaccgctcaactacatggaaactgaacaacctgctcctggatgactactgggtacacaatgaaatgaagacagaaataaagatgttctttgaaatcaacgagaacagagacacaacataccagaatctctgggacatattcaaagcagtgtgtagagggaaattcatagcactaaatgcccacaagagaaaggaggaaagatctaaaattgacaccctaacatcacaattaaaagaactagagaagcaagagcaaacacattcaaaagctagcagaaggcaagaaataactaagatcagagcagaactgaaggaaatagagacacaaaaaaccctcctaaaaatcaatgaatccaggagctggttttttgaaaagatcaacaaaattgatagaccactagcaagactaataaagaagaaaagagagaagaatcaaatagatgcaataaaaaatgataaaggggatatcaacaccaatcccaaagaaatacaaactaccatcagagaatactataaacacctctacgcaaataaactagaaaatctggaagaaacggatgaattcctcaacacataccctttcccaagactaacccaggaagaagttgaatctctgaatagaccaataacaggctctgaaattgagacagtaattaatagcttgccaaccaaaaaaaagtccaggaccagatggattcacagccgaattctacaagaggcacaaggaggagctggtaccattccttctgaaactattccaatcaatagaaaaagagggaatcctccctaactcattttatgaggccagcatcatcctgataccaaagcccggcagagacacaacaaaaaacagagaattttagaccaatatccctgatgaacatcgatgcaaaaatcctcaataaaatactggcacacctaatccagcagcacatgaaaaagcttatccaccatgatcaagtgggcttcatccctgggatgcaaggctggctcaacatacacatgtcaataaacataatccagcatataaacagaaccaatgacaaaaatcacatgattatctcaatagatgcacaaaaggccttgacaaaattcaacagcccttcatgctaaaaactctcaataaattaggtattgttgggacgtatctcaaaataataggagctatctatgacaaacccacagccaatatcatactgaatgggcaaaaactggaagcattccctttgaaaactggcacaagacagggatgccctctctcaccactcctattcaacatagtgttggaagttctggccagggcaattaagcaggagaaagaaataaagggtattcagatagaaaaagaggaagtccaattgtccctgtttgcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggaattcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagctaccgatgactttcttcacagaattggaaaaaactactttaaagttcatatggaaccaaaaaagagcccgcatcgccaagtcaattgtaagccaaaagaacaaagttgaaggcatcatgctacctgacctcaaactttactacaaggctacagtaaccaaaacagcatggtactggtaccaaaacagagatatagaccaatggaacagaatagagccctcagaaataatgccacatatctacaactatctcatctttgacaaacctgagaaaaacatgaaatggggaaggcttccttatttaataaatggtgctgggaaaactggctagccatatgtagaaagctgaaactggatcccttccttacaccttccacaaaaattaattcaagatggattaaagactagaaccataaaaaccctagaagaaaacctaggcaataccattcaggacataggcatgggcaaggacttcatgtctaaaacaccaaaagcaatggcaacaaaagacaaaattgacaaatgggatctaatgaaattaaagagcttctgcacagcaaaagaaactaccatcagggtgaatagggaacctacagaatgggagaaaatttttgcaatctactcttctgacaaagggctaatatccagaatctacaatgaactcaaacaaatttacaagaaaaaaacaaacaaccccatcaacaattgggcgaaggatatgaacagacacttctcaaaagaggacatttatgcagccaaaagacacatgaaaaaatgctcatcatcactggccatcagagaaatgcaaatcaaaaccacaatgagataccatctcacaccagttggaatggtgatcattaaaaagtcaggaaacaacaggtgctggagaggatgtggagaaataggaacacttttacactgttggtgggactgtaaactagttcaaccatttgtggaagtcagtgtagcgattcctcagagatctagaactagaaataccatttgacccagccatcccattactgggtatatacccaaaggattataaatcatgctgctataaagacacatgtacacgtatgtttgctgcggcactattcacagtagcgaagacttggaaccaagccaaatgtccaacaatgatagactggattaagaaaatgtggcacacatacaccatggaatactatgcagccgtaaaaaaaggatgagttcatgtcctttgtagggacatggatgatgctggaaaccatcattctcagcaaactatcgcaaggacaaaaaaccaaacacctcatgttctcactcataggtgggaattgaacaatgagaacacatgcacacaggaaggggaacattgcacaccggggcctgttgtggggtgggggaagtggggagggatagcattaggaaatatacctaatgttaaatgacaagctaatgggtgcagcacaccaacatggcacatgtatatatatgtaacaaacctgcacgttgcgcacatgtaccctaaaacttaaagtataataaaaagaaagaaatttaattattgaaatgaccaactgtccagctttcattgttaacactagaagttttagtagacttctgcttgtgtttggttctatgaaataatgatatgatttttatgatataactagttgtataattagaatttttcttattttatgaactatagtgtcttaaacagtatgtactttggaacacacaactagtgattaattagaattttgctttattaaagcactagttacctaataaataaatatcttttcagcatggttcaaaagctggtcagaataaactagcaaggaaatacaaaaaaaattgactgaattgtagaagatattgtaaattagaacaacacatctaaaatggctcttacatttgtacttatttgcatatattagcatttaaccagagataaaattaggaaacttttagttgtaataatacttgaaaatgattgtataatatagttttgttgttgttttctttcgaacttctattttagcttcaaggggtacatgtgcaagtttgttacatgggtaaattgcatgtcataggggtttggtgtacagattattttgcacccaggtaatcagcataatatctgataggtagtttttcaatcctcatccttcttccaccctccaccctcaagtaggtcccagagtctattgttcacctctttatgtccatgtatactcaatgtttagctcccactaatcatgaatggaagatggttagtgattttgatgaagcactcatcaaaatcaatcataagtcagaacatgtagtatttggttttctgttcctgcaattatttgtttaggataatggcctgtagctccatccatgttgctgcaaaggacatgatttcattatcttttatggctgtatagtatttcatggtgtatatgtaccacattttctttacccagtccatcactgatgggaatctaggctgatttcatgtctttgctgttgtgaatagtgctgcgatgaacatacacatgtatggagacacaatatttaaattagataaatctgttagaatctcaatcatattatacactaactaaacagtatcatcttaagcatgtaatttaagaagtctatgctgagtttacaattttggaaagcaggaataacaatgaatacctcacagtttcttggattttaataactacaagtgccatatagagtggcatagtaaatacttgataagtggtaattaatattttggtttaaaaccttttataaaaaccttctttcatcttcataagttcaaagagacatggtctctttgaaatagaaggaagcaattagttaataagtacctgagattataaagaacaaaaataaagaagaaaagtagataagaattaaagtaagctaaaaatgtaattctaggacaaatttatattagactgcttcttctgattagaaagaaaaaaaaattacacgtgaataatatccaccaaaacaatgacaataagccatgtaagtgacaaaatcgtaaagaaaatccaagagttaagaacactaacaagcctaaataacctcgatttcagaaagtgacaacactgccgagaaaaaaggaaacccatttttaaatccctgccagagtgttgaaaatgatatacatatcataaactgaaggtaagtgaaagagagacattaaagatcagccagtcttttaacagtgttataattacatgtggctgaaatgaagaagagattcctaaaaagcccttaccattgagggtttctaccttaccgccaattcctcttatcaaccagaagcaagtacctcaaggtagtttgccaagaactagggtcaaggaataaaagctgagagagatgtagtgactacagtcatggaagaaaagctgagagagatgtagtgcacagatagggtagcaagagaaatttcctcatggcaagttgaacctttgcaagtgcaaagcaggctatcaaaggttgagtgcggggcagcagaggagttgatacacctctgtggaattctgaaccttcattttgtgcattacagccaccctccaaggactgaggtcatgacataatagctgagataacttccttcaaagctctcttagtcttcagtgagtacaatgaagtgacccaccaaaggctggaggcaggacagcagagtgccaagaaatcttctacggcagagaaatttggtgaaagaactggtgaagaaatcctcagtgactcaaaaatctgggatacaggctgaaaagcagggagaaatctcagatagcttagaaatggatcagctaaactgcaaagcatgaagaaagttctggaatcttgtcaatgctcagatcccaagtcctactgaaggggattttttttttctctgcaccgtaaaatatgtgaagtagtgaactgaatatgattgaaactgcaacaaagactagactagaccaagttctactttaagctacattgtagttccccatattgacatcaaatagaagaatggttaccatttgggggaaataaatatcacttattgattctgtactatttgtacatacagaatatccaatatacaaccaaaaattccatggcacaccaagaaggaagaaaataaattacacatggtcaaaagggaaaacgttccattgaaagatactgagaaatgacctacatgttgaaactatcagacaaagactaaaataaatataatacatatagtaaataatctagtggaaaggatggctcacctgtgtacctagctgaagcatttcatctgagggacggaaagtataaaagaagaaaagaaacatttttgaaataacaaaaatcaattaattagaaaaaagacaaaaagaacatcaacaaagttaaaagtttctctttcaaaagaacaaaaaaaattataaaagcataacaacactagtgaaaaaaacaagagagtaaacacaaaactttaatatcaggaaagaaagaaacatttcatagcttatagactcaaaaagaatagggaaagtaatgaacatgttcagacagtaagtatgacaattttgattatatgaacaaattcactaaatttgggtttgtcttcttgatttctttcttggctatatcattactggtgaatagaaacattgctgatttttatacgttgatttttgtatcctacaactttactgaatacatttatcaagtctaagagttttcagtacattctttagttttctctagatataagatcataccatccatcaccaaaaagggacaacttaacttccttttttgtagtatttctttctcttgcctgattgccctggctaggacttccactactatgttgactgtgagtgttgaaagtaagcaaccttgtcttgttccagttcttagagaaaagactttcaacttttccctattcagtatgatgttacctgtaggtttcacacatatgtcctttattattttgaggtatgttccttctttgcctagtttgttgagtttttatcatgaagagatgttgaattctatcaaacgttttttctgtatttattgagatgatgatatagtttttgtctttcattctgttgatgtgatgtatcacatttattgatttgcatgtgtcgacccagccttccattcctgctataaatcccacttgatcatgttttactatcttttcgatgtgctgttaaatgtggtttgctagtattttctggaggacttttgcatctctattcatcatggacattggcctatagttttgtgttgttgttgtcactttgtttggtttgagtatccaggtaatgcagtaattctggcctcataaaatgagttatggagagtttcttcctctttgatttttggaaacagttccaggaagattggtattagttcattttgtatatttagtagaatctggctgtgaatttatccagtcctgggcttttcttgctattgttttggggagacgttttattgttgattcagtctcactactcaatgatctgttcaggttttatatttctttctgattcaatcttagtaggttttatgtatccaaaaatgtatccacttcctctaagtttttcagtttatcagcatatagttgttcataatagtccctgacgatgttttgtatttctgtggtaacagtcgtaatgtcttgtttttaattttttatttcgttcatctgggtattcattcttcttttcttggttaatctagctagtggtttatcaattttgtttatctttctgaaaaaacaatttttcattttttagccctttttattgttaaagtttctattttatttatttctgttctgatcattattatttcttacagtaatttttggtttgctttgcttttgcttttctagttccttgagtgtattattagactgttagtttgtaatctttctacttttttaatgtagagatttatttctataaatattcttagcattatttttctgtatccatctattttagtatgttatgtttctattttgatttgttgcaataattttttaaaatatccatcttaacttcttcatcaactcagtaatcattcgggagcatgttgtttaatttccatgtaattgtatagtttctggagtttttgttggtattaatttctggttttattccaccatgatcagagaagatacttgataggatttcaattttcaaaaatttgttaagactttttttgtagcctacaatatagtctatcctggagaatattccatgtgctgatgaaaagagtgtatattctgtagttattggagagaatgttctgtaaatatccgtaaggtccatttggtctaaagttcactttaaatccaatatttcttgttgattttctgtctagactgtccactgctgagagtgggatgttgaagtccctgactattgttatattgtacttttgctatctcttttgctctagtaatatttgttttatgaatctgagtgttctagtatcaggtgtatatataattactgtaccctcttcctagattgatccatttatcattatataatgaccttctttgtcctttttttaaagctgtttttgccttaaagttttttttatttaagtgtagttattcctgctcaactttcctttccatttgtgtggaatatctttttctgttgatagaggagttaagatgaaatcacttaggcagatagtaaaggtatgggagtcctcagtaaggcttttctttttaatgaaaagcagccccaaatcattttctaacaaaagcagcctgtaaagttgagctacacacatagacaagcaaactggcagcttgcacagatgaatgctgacaagaaatagggactagacatgttcaagatgatggctccaccttaccttctctttgtcacccacatggacagtaagaaacagacaagatggcaacagccaaggagagagttcacttgcataataagattagggtggggtgaccagacttccccatgcactatgtaaatgtcatacctgatggaaccaatctgtgagccctatgtaaatcagacaccacctcctcaaaccagactataaaatctggtgcaactgctgccagccgctcctttccactctggggcccctctctctatagagggagctgtttctctttctctttctcttctcttctgcctgttaaacctctgttcctaaacatctcatgtgtgtccatgtcctaaattttcctggtgggcgaggacaaacccagggtatataccacagacaatgtagccactttaccattactttactttttagtctatgtgtgtttttacgggtaaggtgagtttttgtaagcagcatatcattggatcatggttttttcatccataaattcagcttttctgtatattttctgcagagaatgtaatccatttatgttcaaggttattcttgatatgtgaggctttgttcctatcatattgttcactagggtttttgttgttgttttatgtatatttttgttcctttctttttctcttactgtttgaccttgtagtttgttcactactgaattctttcaaacaattacatgaaaattaactcttatataatctcttttaaaaaacagcagatgaggttaactttcccaacttattttagtaggccagcattactctaatgccaaatgctaacaaaaatattataagaaaggaaaattataaagtaattgttctcatggactcagacacaaaaatctttaataaatttttaacaaacagagtctattaatgtacaaaaagttaacatattataaccaagtagattttattctatgaatgtaagtctggtttgataattaaaagtcattcactactatacaccacattagtagaacaaaagagaaaaacatatgataatctcagtagatgtaggaaaagcacttgacaaaatttgacatccattaataacagaagctcataactcgtaataaaatgatgttttatggatctcataaaggccatctaaaaaatagataaagtatccttggatccctctactttgtgaagaaaggctgaatgtttttctcttaaaattcctctactgtatctcctagcctttacaatgatgtaagaaataaataaataaagcataaagaattttagaaagaaacaatattttccttatttaatgaaaatattgaattcatgaagaatcaaaaggaatctacaagcaaactagtagaactaagtgaatttagtaaagttacaaggtatggttagcaggcaaaaatcaatcatattacataatggaaataaaaaattataaatgatgtttaaaaacaatactattcaaaaagtttaagatgccttaaattcctaataatatatctttcaaaaagaaaaagatagcatgagcctttacataaaaaactacagataattgatagaattgaagaagacctacataaatgtagatataaactatatttatgaattgacaatataaatattgttaaggcagttattctccctaaatggatatatagagacactgcaatcaataaggaacttttagcagaatattttttaaaaacctaacaacttaaccctgaaatttatgtggaaattcaagagaatctaaaaacagtactatctaataaaaatatattgtgagatacacaatttaaaattttctactagccactttataaaagtaaaaatgaactgtaaagttaattttaataatgcatcatattaagccaatataatcaaaatattatcatttcaacaagggatcaatattgcaaaattactgagatattttacatttttttcaatctatgttttgaaatcagtgtatattttatacttgcatcacatctcaatcaggacagctgcattttaagtgctcaaagccacattgggcagatggctaacatattggacagcatagatctataatatgcaaaacaatcttgagagaggaggaggagaaagagtaggaagtggggaagaagagcaagatggagaagaacaagatggataaagagaacagatgtgagaaggagaaagaaaacaagaaaaacaggaaaagatgtgacggtctagcccaccccattctgagagtagcattagcataaggagagatatataactgaaagataatcaaggctctagaaacacagtaatattcccatacatatatgatcagttgactttcaaccaagatgacaagtccattcagtgggaaaggaaaacttctattaataaatgattttggaacaaatggacagtcatatgatttttttaagccttgaattctaactctgtacacaagaattatttttaagatggatcatagccccaaatataaaatccagaaatataaatctttctaaaggaaacagaaggctatcttcacaacttggaataggcaaatatttcttggacagaacataaagcactaaaaatagaaaagaatttgataaattggacattgtcaaaattaaaataaatgttaaaattagaaacacactgtttagaaaataagaaggcaaaccaaggaccaagagaaaatattctcaacacattgacatgacagtgtcttgagaggggcagaaaacaaacaggaaggaacaagtctcttcttcctcctcagccttcctgtctctctccccatagcaattcctgctgggagatcctaacagggagccatctagcaaaggggaaatgtgggctcagagtctcagcaccaacatgacaaagcagaacatgaaaggatgggtctgaagttgagagacaagaccttcacttctagcacagacatacataaaataatggtgcatcctgtaagtgatgacatcttagatgcaacaaaaaagctgtatataattatatactgtattgctatcattacattataaactggatataattataatttgtctagaatgtaatcttttctctaataattaagaataaggaaagcagtgtattgtggtttagaacaaaacttagtataatataaaatggatatttctgccctctaacttcagagtatgttttcttgagataattgaaattagtggggtacaagacagtaagctcctgacctggttatctattcttattattcttatctatctattcttatgtttcttattaacccaagaaacaaagcccatgctgccactttggctggtcaataagcatcattaactgtccagccatttctcgttcttcacttcccatctttcccctcttttctgtatttgtactttcttcttagaaatggaattagagatgaaccaagaggatatatgtgattcccacaggctgtgagtcagtcttttaccaaaccatctaaatttcttctttcctcagtaaaacacagtgcaaaaatttaacagataacttcctatgcaaatataattgtgaaacatcaaaaccagccacgatgaaaggcatcaacattgctggctgaacattttaatctatcaataaaagcaaagaaatgtttaagagactgctggggaaaggaaggacgtgagaatctctctttctatcccctttgtcattctagtcagtatgtacccatgtgccttacgccagttttggcagctgactaatagaactgtacaaatattggagaaaatccagaaactaatgatgaaagtattttccagtgataaaagggtaaagaagattaaaattactgattggaaaggtaatctagaatgaaaagcagacaatccaagatataaagctgagaatggcgtgaatgttattagcaaagtagaaaagtaccagaaagatctagcagactaaagttcacagtgagttagcactgtactgcttctcctttctactggcagcaacataaataaatgtgacttaaaattataaatgtgtcatccatttacatatgacaaatttttctcatccctaacttattttctgcctaataattgagacggcattataaactgtgtccatttttaatgtattttaataagaagaatactgtaatcaagatggaaaattgaactgaaatgaaaagccttcatccctacaacaaacatatacaatgaacaaataaagcatatatttttttcaaaatatgtaaatacagatttaagttcaaaaatcataatatgaaaagtccaggtgccagaacaaaaggaaatttccactctaagaaggatctgagtcacgggcatgccgctgtataccaggctgtgaggtctgcctgtgtaagcctagaaactgaggctatgcatctcacagtcaggaaaaaataaacccgcgttttctctacaagtgatcctctggatatgaagggaaagaggcatccaagggaatgcagaacccctaacttgcaccattccacatgcggaaattcacattcttgcactacgtataaaatcaatacctaatataaaaacctataagacactcccagcttcctttttaaacacttgtaattcatattttatttatttatttatttaagacaaggtctggtactgtcacccaggctggagtgcagtggcatgatctcggcccacagcagcctctgcctcctgggctcaatccatcctcccacctcagcctcccaagtagctgggaccacaggcatgcaccaccatgcctggctaatttttgtattttttgtagcaacagggtttctccatgctgctcaggctagtcataaactaatgagctcaacctatctgcccacctcggcctcccaaagtgctgggattatgggcctgagccactgagcctggctgtatgtatatttatttctatttgctccataaaaaaaaaaatgcactagagtgactgggagtatgtacgtgcatgtatgtgtatcctttaattgtcactgtgttataaagcaaagaatcaccaaaaaaagagaaaatgagaaaggtggtaacagtgaaaattaactaattaattaataatttttaatttgagaagcagaatgatcaacggttctactctgggagagagaaagggaagtagatgaatctcaagctagttgtagggacaggagaccacctgatttgtaccataaattatcaaaaattctcaagaatttgcagcaccagtttcctactcctattatgcctattcttgaacaaaacactcaaggtctctaaaagtgtttacgtcataaagtatgtctacctcatgaatgtttatcccctcagactcctcaatttctggaatactgtgagtcagccaggaaactcgggaacccgaccaacccaaagaataggcctaaggtaacattcacttagaggtctccacaaaatggctcagccagatcattctttgcagatgtccaaagtaggcaagtctcaattccctacaccaagttgccaaagaactttcaactgcctcatgttaatttgagtagatgaacaaggattgtcaggcacttgaaacaagccacaaacacagagaaaatataaaaacagaaaactgagactacaaagaaaaaaataacgataaaaacagaggaaaattgtaaataccataattaatatacttatagagatagaataaaataatatatgtaggaatcaaggtatttaaatattgcatatttacgaggaacagagaacgtaactaaacaagttgtaaaacagaataaagtgtaaacagaatataacgtcaaggaaatctcgagaaaggtctggcatgcaccagaatttgtcgctgtgtgtaaatgagggagctatggcagtacagttattttcaaaaaatttatattgttgaggggctatcaagaatagctaaaaactgtagatactcacagagactctaggaaccaccattccactctaaaggtaattgcatttctacattgttttataaagtctcgttttgaatcttttaccgtcttcacatgaaccgaaaataatttgaatatctgaaaatgtaccgcaaacacaaaacttttgagaacatctaccatgaattgaggtttgtcattacctacaaagagtatcccaattttgatggcagtggcagccagtccggagcagccgctgcaaagaccccagctgcagcatgggtggcccatcctgggctgtgctccatggagctggcaggagtcgggaacaagtgggagtcccgcccccttccaaattggctggacaggagccccaccctcctgggcacagctgcagctgcccagcgcggctgtgcacctgcgcattcctgtgctttcgggggctagggaagactcctgcctttgcaggctcagaagtgtctgctgccgctgcctggtccctccctgctcccggcgcttgctccaattttggagtaaagttgagactgagcccaggcactgctgcaacctagctgggtgtgcccacgtttggggcagtgctgacacgccagccccctgccgcatcacccccactctgcactttgggtgctaatgaacatgggagggaggccgaggaggaggggctgagagcagcttggcgctggcctacaggcaccccttggcatggacagcctgggtacagtggacagcatgctgatggtgggaggcagacaggtccctgggaggaaaggggcgggtccctgatgaaaccccaccttcatgccagggacggcctgatgcctgggggccgggttactaattctgggtagagtccaccgcccagagtgggaccttaaggtgctttttccaagcccactcagactgcttatggaccaaccagcatgcacttcctcccttctgagcccataaaaacccccaacatagctagacccacacagatatggggaagatctgcctgcagaagggagctaaccactacatgtctcctttccactgagagctggacagacgtcttgacaacccgcctgaagaagggagctacctactgcgagtctcctctccactcagagctggacagatgtcctgacgacctgcctgaggaagagagctgcccattgcgggtctcctctctgctgagaactggatagacatcgtgacaacctgcctgaggaagggagctacccactgcaggttccctctccacagacagctggacagacgtcatgacaacctgcctgcagaaaggagctacccactgcaggtctcctgagagctgttttgtctctcagttaattaagctcctcttctcctttttcaccctccagttgtccatatacctcattcattctggactcggtacccactgaattgtaggactgaaagagctgtaacacaaaccgggctgaaacacatcaccctgctcaccatgttgctggcaaggaaaaggagagaagagctgcagcccttcagggagcccacacgtaggggatccctgagccagggctctgacactctctctggggctctgtggttcctggcatctccaagcttccaggctccactgcatcccccctcatccagatgtggtgaccagcagtggaagccacatgcagtacatctggtccagccacagcttcacacggagctggcacctgtgcagatgcctggagctacttgccctggtgcagcagccagtgtgattgactgtgcatagtggccagatgtcacactcactcacccacacatccctcgctgctccatgcctggctcacccttggcagctgcgggatctgggctggtagcatgagccaagcacagcctgccaggcttagtgggcagatcgagcccagtgggtgcaagcaatactcaggtaaaaggcaccactggccacagaggtttctggctggcgaagcaacaccccaagacaacttcaagacaccccatgacaacttcagtgtttgttattcacaatattctatgtcttgttcccagcgcaaattttgtgcattaatcctcactcttaccctgccttattcacggatgactcaaaattactgactgttctttatgtatctttgtattatcccctaattaccacgtaaagtatctttatatatattacacacaactattcgtgaataaatgaataaatatttatgaataaacaaatgagtcatattgggttaacccaatttaagtccctaagttaattttgttgtctgtgtaaagcattggctaaagacaatctctacagactagcaaacttattatgaaatctattctgtgcctactatgtgtaagacattatctatgttatccacattatatcatttaaatcacgggctgatcatagcagtgtttaacttctgtggttttgaatggagaagagcaatagagaatttgttaaccactatctgggtcataaaaatgggtttctaaggaggggtatcactgaagaaatgtaaaatgcaagcttagttttcaaaactctgtcctgattttcaaaaaaacactgttaagctttaaaaatcgcctcatgcatcatggaaaacagaattaaaaagctaaatattctaccagaacatggaacttgagtatggactcttgtgtaaatgaatataagtgttattaaagatgttttacttaaaacaattgaaaaacctcatctgtatcatggaataatcacttttgaaactatggaaagtttaagtcatttggaataaaattatttgttaaaattgatttcactcatctttgggactaggggaaaagtgatatataaaatgatttccatcaatatccaaactatggagattacatatagtcagttgtctgtaaagtgaagctattcatgaaaatggaaattctaagtattcttcacccttaggaattttgatgctatcaaattttattgaaataaacacagagatttattccaagtattgaaatatattcattaaagagctcagtaggataaaaagaatactgagactctcctgtggtttctgttttctctaaatgttaatacttgtcacagtgtatatcctgcctactataaacactaaggttttcaatcatttcctggaatatcacttaccagtggatccaagctttctcattgtttttagcaaaatgtagctcagtttgtatcttttgattttcttcagtattttaataataattattattatgtaatatttgttataaaagtaattagatcaatagcagtgaccattattgattctttcactgtgctaggaattggacttagcacgtcacacatatatcatttaatcttcaaaacaaccacactctgaatatatccaactgccaaatgtattggtttcttattgctactctaactacagttatcaaaaaaattaatggattaaaatatacaagtttattatcatatagttctggaggccagaagtccaaagtcgtcttactgggctgaaaccaaagtgttaacacagctgtgtttcttccaggaggctctaggagagaatctgtttctttgttcgatctctagaaactgtgggcagtttctagaaattgcccacaatccttttgctcacggccccttcccctatccccaaagccagtgacatcagacagagttcttctcaagtgattgtctctttggttcttcacagtcacatcttcctctaactcttttaaggatcccctgatcacattggctctgcccagttaatccaggagtctccccatcaccggctcagctgattagcaaccttaattctatctgcaagtttaattccctttaccatgtaacctaacatatgaaaaggctgtcgggattaggacatagagattttgggggagccactattctggctatcacagcagacaggaaagataaagcatcataattaatcccaaggccaacagcaagcaagtggccatgtcaggaatcaaacctagctctgtctgatcctataaattctccctccatattatctcaaatacagtttactgaatgaccaactgaaatttcaaaagaaataaaagaaaaaaaaggaataaagaaaaattcaatcagcctttgggcaattattaaacatttagaaaaatccagttacttgactatagtatctttcacttctcattcagttgtttggtacaatatagatcacgacctctgatgaagtcccatttgcttctcttacttatttacacatcttgaaccatcagaatggcagatgatcttctattaagaaaatatgcagtgtaagcaattaaaaattgtaattgatgaacttagcatttataaactggctagaatcacacttaaaaaaaaatctgtggattttcaatgttaacatcttttatatagcagtttcctaccatgacctacaatactacaaaaaattgttgctgcctgacatgggtatacttgaggcattgtaataagtaggattgttctttatggctctgccacttgccagtcatgagaacttgggcaattgacttaactttcctaaatgttggattctgtatctgttaaacaaggatcattatggtgtcattggttagagatgataaatgtacattacagtataccgttcactgcatgtcctctgacacaatataagtaccaaataaatgtcatccaaattatttttccagtttttagcaatttatttggacacataataaatcacattaattgtagttattatttttttcagtagcaacatttactcatccgaaccagaccttcttgagtggcttatatttcagtatcatttcttgcataatttttcaaacttcatatagtttgtaaaggaaaaggaatatataaatgaattacaagacagcatcattatttcctttttcttattttttattcagcatctattgactttacaaatccattttgaggcataaatctaaatgagtggcattttcaaatattagataatgaaagcttatttgtggtcattgttctctggtggcagttttgactttctgccccatagccttcactaaactgcaaaactcatagaagttattagtgatgatccagtgcatttgtttcctggacgatgaaactccaaattccagatgggattattctccattttatgcctgtccagctctggaatttctacagccattatcaatgtaaattaattgcagttgattttaaggttacaagtgacataaagctcaatattcccttgtccaaaattattgttattgaaataggaaatgccctctttgtaacattattttggaggctagcctccatttccatggactcatcacaccatgtattagattggcataaaagcaactgcttttgtaccaacctaataaaaggacattggctctgtttcaactccatggcttgttttgaattttttttttttttgacatctagtttcactcttattgcccaggctggagtgcaacggtatgatcttggctcactgcaacctccatatcccgggttcaagtaattctcctgtctcagcctcccaagtagctgggattacaggtgcatgccaccatgcccggctacttcttgtatttttagtagagacaaggttttgccatgttggccaggctggttttgaactcatgacctcaggtgatctgcccacctcagcctcccaaagtgctgggattacagacgtgagccactgtgctgggcctgtttttaattcttaaagagaaagtatgccctcactatttattaccaccattgtaacagttacccttcctgtaggaaagcactaattgccctggagaaaatcaagatatttgtaaaaatcattgttgatctcaaattagaaacaattataaatcccaaagagaaatatatgtacacatatattaggatgattacatataatatatatataggcttaaagtgatacaatgttagatgatattttaattctaagtatcaaaggagggatcttagtttcctgggctccatgggggtgggacccacctggcaagccagaccacttggctccctggcttcagcccccttttccaggggaaattaatttcattttttgtatctttcccatccctccattattgtccctatttttttctaaaagaattgtctcagaaacagaagtcctctgaactgaaaattgtcacgttcatattttttcacacattgttgcatgttatagcaacattttatataaaaacattgtgcatattagtaaaaatacctcttttttataccctctgtaatagtcactacataaagaaatgaactgaatgcggattcaaggtggccgattaggaatagcaccagtctgcaggtcccagagagactgatgcagaaggtgggtaatttctgcatttccaaatgaggtacctggttcatctcattgggacttgttggacagtgagtgcagcccacggagggtgaactgaagcagggtggggtattgtctcacccgggaagcacaaggggtttgggaattttctctcctacccaagagaagccatgagggtctgagcctgagaaattccagcacagatgctgtgctggtcccatggtcttcgcaaccggcaaaccaggagatcccctccagtgcctaccccaccagggccctgggtttcaagcacaaaactgggtggccaattgggcagacacaaaacttgctgcaggagctctttttttcttccataccccagtgaggcctggaaaaccagcaagacagaaccattcactcccctggaaaagggggctgaagccagggagccaagtggtctggtttggcaggtcccacccccatggagcctaggaaaccaagatccactggcttgaaattctcgctgccagcacagcagcaatctaaaatccacctgggacattcgagcttggttgggggaggggcgtccgccattgctgaggcttgagtaggtggttttacggtcacagtgaaaacagagcttctgggaagtttgaactggacaggagcccactgcagctcagcaaggctgctgtggccagactgccaggtgtctcctctctggacagggcatctctgtgaaaaaggcaacagccccagtcaggggcttatagcagacttaaacatccctgcctgaaggctctgaagagagcagcagacctcccagcacagcattcgagctatgctaagggtcaaactgcttcctcaagtgggtccctgacccccttgtatactgaatgggagacacctcccagtagggggccgacagacacttaaacaaaattacaagaaaaaaacaatcccatcaaaaaatgggcaaagcgtatgaacagacacttttcaaaagaagacatttatgcagccaacaggtatttcaaaaactggtcatcatcactggtcattagagaaatgaaaatcaaaaccataatgaaataccatctcataccacttagaatgatgatcattaaaaagtcaggaaacaacagatgctggaaaggttgtggaaaaataggaaagcatttacaccgttggtgggagaataaattacttcaaacattgtggaagaaagtgtggctattcctcaaggatcgagaactagaaatatcatttgacccagcaattccattactgggcatattcccaaaggattgtaaatcattctactataaagacatatgcacacatatgtttactgcagcactattcacaatagcaaagacttggaaccaacccaaatgttcatcaataatagactggattaagaaaatgtggcacatatacaccatggaatactatgcagccataaaaaaggatgagttcacgtcctttgcagggacatggatgaagctggaaaccgtctttctcagcaaattatcacaagatcagaaaaccaaacactacatgttgtcactcataagtgggagttgagcaacgggaacacatggacacagggagggaaacaacacacaccacggcctgttggggtcggcgggctaggggagggaaaacattaggagaaatacctaatgtatgtgatgagttgatgggtgcagcaaaccaccatggcacgtgtatacctacgtaacaaaactgcacgttctgcacatgtaacccagaacttaaagtatatgtatatttatatatgtatacatatattattatatgttgatatatatgtatacagatattattatatattgatatatatgtatacatatattactatatattatatattatattatattatattataatacatattttataatatatattatatatattatatatttttataatatataaaaacataaaaatttataatatatttataatatatattatattgtataacatatattatatattatatatattatataatataatatatattatatattatatataatacatataatatatatattatatataatacatatattatatatgtatacatatattatatgtatacatatacatgtatacatatacatgtatatattattatatgtattatacatattatatatttatacatatatgtatgtatacatatataatttatatgtgtatatatacatatataaataatatttttatatataaatttaacttatatataaatttatatatatattaatatataaatttatatatatattatatatgtatacatatatatttatatataaatttatagtttacatataaatagatatatttatttatatatttatatatttatatatttatattttaatatgtatttatatatttatatagttatatataaattatatgtataaatatatatacatatatatggatatttatacatatatatttatatttatacatatataatatattatatatttatatttatacatatgtatgatatatttatattgatacatatatattatatatttataaatacattatttatttatatgtataaatatttatatatgtatatatacatatataaatatatgtatatgtacatataatttatatatgtacatatacatatataatatatatacatatataaattatatgtacatatacacatatataatttcatttatatatttatatttatacatatatattatatatttatatttatacatatatattatatatttataaatacattatttatttatatttatatgtgtatatatgtacatatacacatatatacatatgtatatatgtatatacatatgtgtatatatatacatatgtatatatgtatatacatatacatatataaatttcatttatatgtgtaaatgtacatatacatatataaatttcatttatatatgtatatatgtacatatacatatataaatttcatttatatatgtatatatgtacatatacacatataaatttcatttatatatgtatatatgtacatatacacatataaatttcatttatatatgtatatatgtatatataaattaaaatatataaatatataaatatgtaatggtgagttcatttctatatatatttatatatttttatatatatttatatattatatatatgtatagatgggaggtgattcaaaaacattgaactaaatgcagataatgaacatgtttccatttgttctctactatagaagatgagatatatatttttttcttatcatattattttcctaaaggacatataacctaaccaaagtataggggccaaaggaaaacatttccttcaccttctaagcatccactgaaaatcagctcacaaaagacagattaactggagagaaggcatacaaacttattaacatgcatacgaggcagaaaaatagcaattacccacccctcagtggggttcaaaaacttacatatcatcttcaggctatataaagactgtgggcttggatcctggcaaaattgtttaagggaaaggggagaagaggattttttttttttttttaagataaggtcttggtctgttgtccaggccagtctggagtgcaatggtgcaatcatagctcactatagcctcaaactcctaggttcaagccatctcttgcctcagcctcccagtagttgggaccatgcctggcttatttttaattttttatagatacaggatcttactatgttgcacaggctgctcttgaactcctgggcacaagaagaggaattctgttgagggacaatgaatgattattagggagaatgaaaggattggggacagagattggcctgtaaatatttctctttggaatttacatgaacctgagcaacagacattatcttgtgaaagggtgtgttcaggtgtggttacattctgaatcttctttctttaatagataacgagatacagggaggggactgaatcttctttctttaatagataacaagatacagggaggggaggaacaaaacaattgttctctatggtgggaccttactgtctttatataaataggggaaagggctcttctagtgtctgctgatgtgtaagagctttaacttaaaatattcattataccagggagccatattttggggtgaaattccttgcgctccttcagaagtaaactttagaaaacaaaacattatgtggaatttcataactagcttcagctcatccttggctcttcccctttgtctatggatattaggtataaatcccctcaagctagcttctccttgcagttttgaggtatttaacagtttttcatcctgtgccttaattttagaccaagagaaaacttttaagagtccaaacccagcagctcacaaacaaggaaactggttgtagcccaagtgacttagccaagaaaagagcagatctactgcagaaggaatatcatagccaaagtttcttcatagtgaaactttttggcattgaatgctggcttcacccactacagaaagtagagacttatacttaactttaggtacttattgtgcttaactttgcaaagcctcagttttatcaaccataaattaggatcaataatcaaaataccaccctgctaagggttttatgagaactcaatgaagaaacctattttaaatgttttttagatttatgtttattcacatttttactcccttccaaaaccccaataacaaggcagaaatgtaatttttagaaaacataattgcacaaaagctaatatacacacacacacacacagatagcagaactatatcatctatctatctaactgtcaaaagtgaatggaggatccataatttacttgatagtgaggaataaactaaccacaagacttggagtaaccagctaccacagtctgagagggtgagaatatagccaaaatggtgaccaattgttacataaaccacagagaatagaagaagaaaaaaatcccaagggttttcagacccaatgtcatgaactggatggcaatacgtataaaaagatagaaccacaaattttcactcctttcacctgtagctagcaattacccgtagaaatggaggttgattctctggagaaattgatgcaggatactttcttcaccacttcgtgggagttgccagaggggtgcctcatttattcagcctatcccacacaacccctcacagaaggaggtgtgcgagccaacaagtgcaggaagcagccactttagcacctgcacgagtgaactccattcactcgggtccactgggctccactccttgcaggagggagcacacagacaagtgagtacaggcactggccactttggcgctggcagaagtgaactccatgcaggccctgcaacagcgtccagatggggtgtctgcgaccccaaggccccagagggcgtggtacaatgctctcttagctctgccgtctgcagaaagcagtgtgttaccagctcagcaggccctctgcctcatcacatggggtggctgccctccaccagcgagggtgaagggtcagtgtgatagcctttttgggtacccgcacccggtgcctcctgaattcttattcagtgaccaagaggaatgaggtcacatggacaaactgaaggataatgagtgttgagaattttattgagtgatgaaagtggctctcagcagagaggggagctggaaaggggacaggaagggaagctccatctcccctgaagtcaaattgcctttctgcctctctcttccaaaggcaagttgcctcatccacccactgtctcaaagttgcctcttcttaacatccagctgcttcttcctgacatgctgccacttctctctgccaggtgagtctgggatcttcataggcacaggataggggtggggtaggctataggtagttttggaaaaggcagcatttgattggtaaaaagacattattcaaaaagaaccaatcaggagcgagcaggcacacagggatggaagttctcactttgggccacaggtttcaggctcttcggctcaaaggtgaggttttgccagggacctgcccttgtctgcctagaatctctctgcttcctgcctctatcaaaatgggcctaaataatgataggaggtggggcttagaaatgaaataatagggccgggctcagtggctcacgcctgtaatcccagcacttcgggaggtcgaggcgggcggatcacgaggtcaggagatccagaccatcgtggctaacacggtgaaacccatctctactaaaaatacaaaaaaaattacccaggcatggtggcgggcgcctgtagtcccagctactaaggaggctgaggcaggagaatggcgtgaacccgggaggcagagcttgcagtgagccaagatcacgccattgcactccagtctgggtgacagagcgagactccatctcaaaaaaaaaaaaaaaaaaaaaaagaaatgaaataatagtgtagcaagttcatcttaatgataaagactgaggcaggaaggggaactgagaactgtgaatagagaaggggaagagggaaatagcaaatgcaaactttcagctgtgatgtgtgtagtagtacaatatcgaatataataattaaaaatttcattttattagccttggaaaagccacacaaaatattttttgaaggagtagtaaaccaaagataaaattcttagcccctagaacaatctgagcagatcccttctcttcaccaagagcattgcaaagttgacctgaaaaactagttcaggccatgatggcaagggggatcagacatacatcattataccctcctccccttgtggaattcagcaaaagctcaccatcattaacatcaaccagaccttaagtctgataagaaacatttacaatctattttccctgaagcctactacctttatctgcataataacactttggtctccacaaccactaattgtaacccagaaattcctttctattgattccaggtctttagataacttaactctttcaactaattgcgaattagaaaatctttaaatttacctcagtggcctggaagccccccactttgagtggtcccacctttgcgggtctaaccaatgtatatcttacatgtattgactgatgtatcatgtctccctaaaatgtagaaaagcaagcagtagtaccccaaacaactgggggacacgccatcagaacctcttgaggctgtgtcacaggtatgtccttaaccttggcaaaataagctctcaaatttcattaagactgcttttaggtacttttgtgttcacagggtgtaactgtttaacccttttaaaaaatgactaaaaactcttttacattgttaatttagtagatgaacacatgaccaagatatttctggggttgtttgttttttgttttgggacggagtctctctcttgtcacccaggcagtagtgtagcagtgtgatctcggctcactgcaacctctgcctcctgggttgaagcaattctcctgcctcagcctcccaagtagctgcgattacaggtgcccactaccacgcccagctaattttttaatttttgtatttttggtagagatagggtgtcatcattttggccaggctggtcttgaactcctgacctcaggtgatccgcctgtctcagcctcccaaagtgctgggattataggagtgagccgctatgcccagctgtgctatttcttatatagtttccactctggggagtattctttgaggccaaatacatgacttcttttccatatttatttattttataagtgtttgacgaggataagtgaggaatctatatcttctatagaggataacaacacaaatatgtatttgcaggtatgtttatgtgtataaaacatcaagctggttgagtctcttatccaaatcattgtgtgtgtatatgtgtgttcttacttttttatttgcttgatttttagttactggaaggcatggattagaaaattcccctatattgtatttttttatcaagtaaaatgagaaagtaaatacctatcattgggtgattccttaaataaatcatgattaattacatattataatcattaactaaagaccatgagatctgtagtgagggaatgggagagtttcattttctattaaaaaaaaaaaaaccctgcagattggagagatacagccttcaatgcaaaacaaaaacctgctccaaaggggaggtgaagtgttagattatcaaggcaaaaaccacagggccggggagggaggcaggggaatcaggagcagagacttgattggacgaccttcaggctcaaatcaccagtctctctcagttgattggttccaggtggtttgctgctgctgagttgggaaatttccagtaggaactggtttggtttggaccacctgtaacatttctaccaagtgtctgacactagctacctggagatagcatcagatcaagtgtcccaggcagtccaaaccaaaccaagtgtcacaaagtacatgattgccccttcactaagctgcggccccctgattttgtcttaactttgaacacctcagccacatggaatccattttttctgctggctgggggcatactttaacataataatgtaatataaaatatgtagtatatagtttagtcattataaacttttatatgcacagtgtatgactaaataattatatccaactataatgaaatataaagtagccagtagcaaaatagacatagatcttttaataaggacgctgccaaaaatataaaagtaaatataaatataaaggtaaaaataaagttacaaaatagaattatagatattgtataattttatatttaagtaaatacatgtacatgcatgtatacggttgcacagttatgcacagaaataaatttggaaggatatgccccaagatattaacaccggtgctttaggatttgggggatataagtgatggctactttttcctttattctcctttgaggtgatctgacttctataagtatactttactttaaatttaaacaaaaaataataaaactggactgggcacggtggttcatgcgtgtaatctcagcactatgggaggccaaggcaggtggattacctgaggtcaggagttcaagaccagcctcgccaatgtggtgaatccctatctctataaaaataacaaaaattagctgggtgtggtggcgggcacctgtaatcctagctacttgggaggctgaggcaggagaattgcttgaactcgggaggcagaggttgcagtgagccaagattgcgccactgcactccagcctgggcaacaagagtgaaactctgtctcaaagataataataactactttcattttgaaaagaaatcactaggtaaatcggttgtcattaatcatgttccaaagataataattacttattaaatttactcttgtgtatccaaaatttcataaattaaacagaattaaacataaattaaaacagaaaaactactcatatgcattcgctcttgaaggttgctcaaatgccaaacacaaaagtcaatatgtcattataaaagataggaaaaaccgaagtgttttcctactctgacagaactcaacacaacacttctgacacaccagatgtgtgagagttgtttctctacacaccaagcaagtctgcaggggacaccagttgggtgttatctaattcaattcaattctgacactagcttcctggagatagagtcagattccacaagttaaaggctcagtcctacaagagttctcccttatttcatatgccagttgcaggtaccagcttgttttacctgtgattctgaccaacaggttagggctatgatttataagattcccaatctccttctcagattcctttaatttgctattggaaaataaaaataaaatcccaagcggccaggcacggtggctcacgcctgtaatcccaacactttgggaggccgaggcaggcagatcacaaggtcaggagatcaagaccatcctggttaacacgttgaaaccctgtctctactaaaaatacaaaaaaattagccgggcatagtggtgggcccctgtagtcccagctactcgggaggctgaggcaggagaatggcgtgaacccgggaggcggagcttgcagtgagccgagatcacaccactgcactccagcctgggcaacagagcgagactccgtctaaaaaaaaaaaaaaaaaaaaaaaatcccaagcaccccaatcaactgagcaaaccccttgtttgtcttgggaaacaggaccccagggaaatttttaaaactgagttctaggccatgacaggaaaggaggttgatgacacctagtatgtcccttccttattaacctttagccagaatcctttcctaaggcatgagcagaagccagctctagaaaacaagaaaaggaggacacattcttttactgccttcagcccgtcatctgaggttaccaccggactcccgctcctctttgcagtttcagcttcacagctcaccagtttcacaatgaatcccttcctgaaaactgactaccatcccagatagattttggcagacttgaggaggttgctcagtgagggttttgtgtcaccttttgatatcagaagaccaaaaagtccaccctcagattacactaatgctgcgttttttaaacaagcaatccatgaagaggcatgaagctccattgagcatgttcatgtttctcatttcgtaaatattcatgagtcctcatatagctcacagaatatgtacacttagccaccctgctcagcataaattcctgtcttatgcttccctcccttgaagcactttcactggatgctatacttcccagcctaacagaaaggccaccctacaggctgcaaccctttatgaggaataaagctctcctttccaaatttatgaacctcatgatgattcagttgacactaggaaggttcataagtttcaggggaatcacgtagcctttcccaaaggttacagggtattgattaggcggttgaaactgccaaccccctaatcatgccttggtctttctgttgaccagcccccatcctgaagctatctaggggaccctagccaccagttatctcattagcatgcaaaagacactcttatcactttggagtttccagagggtttaagagctctgtaccaggaaccaggagcaggcagagaccaaaaaaaaaaattcatattacatcacaatatcacagaagtctatacctcagaactctgcaaaataccattgcaaatcctgttacttcctgcaaagtacttgtgtcatttagttaaataatccaataagcacattctcaagctgtagctttgtttatattttctctaaagatatgttcccaagtaataaaatatatttgctgttatatttgccaagttgatccttagaaataagtagttttttttctttcttaaaatgcattagagactatagatatttagaaataacttttatttagcttatatgggtattacctgatgcaataaattactatactcttttcacagaggagttttcattctataagttgtttactttgggataaagattaagtcatgaaagtgtatataagcattatgctagcatttttgatgacaaaacatataataaattgtattatttatatgatttttattttcatatgatgaggaatttaatttgaaatctgttcatggacttacatttcactactgaggctatattacctactggaaaggggctaagatagatgtttttaatttaattttctgactttttgacggagaatgctttgtaacttttacatgacatatatcagatcaaaatttactattcacattccacttagtaaaagtgcccaagccatatggtttctaggctctagtcttattaccacataatatgttcctttaatctcttctttagcactcaaaacaaaaatgcagaaatcccagactctgagtttctctgatcttgtatggtgaagggcccactcctatttttcttcaagtttttaaacagtcctagaaaacaggttttcatacaatagatcaccatttcagatttttttaatgtcaatattcatgttttctcaagcacagagttctgttttagtgcatttagttgatttacaaatgacttgtactgactaatgtataaaacatcttaataagagaaagggttttatcatgaaaactgtgccaaagtcctaagtccaatatctatcataaagggattaaagtcttaagtattacactgtcctctaaattaaggaagttatctcagctcaatttctagcagtttctgaatgtgatttaactggatatgcagtgattaaatatcttgttgctatccatttctgggaggattaactccatttaaatgaattctctttctcaatatttatttcaaataattccctagactatcttagcttatggtgaaataactcaggaagttatttcatgtggaaaatcaaaaaacttaaacttcaaatttcagtgttattaagcttttcttcttgagcaatctaatgatagggtgtcagtgctgggatgctaccaacaatgagaacacttaataagtcatgaatatgcaagatacaatagacagtgctgatttagaaatcttgagactctacctgatctgcttttccttaatttcattccagaaataattgctccaatccctattctgtacaataacctcatcaaagatgattttaaaacatctctctatattggatatattatattaataaatggatcatatcatccttatcatgttgctgatatgcagagaatccaggaaagatagttatgaaggaagggtacctgcgagtaccttccttcaaatattctaagtcaattgagagatttaaatttttgttgatattctattgttattgtcttcttagtgatatttttaaatggtttcaaatatggcaaaatagacataacattagatttaccatttttgccatttttaagtgtatactttagtggtattaattatattcatactgttgttcagtctttaccactacccatctctagaactcttgttatgttcccaaactaaaattcagtacccatcagatgataactccctatcttccccctccctcagctcttggacagaatcactattctactttctgtctctgaatttaaccactctaagtacctcatataagaaaaatcatagaatatttaccttttgtgaaaaggtaaatttgccatttacataatgcccccaaggttcatgcatgttgtagtgtgtctggagttggttccttccagtgggttcatggtctcactgacttcaagaatggagctgcggacctttgcagtgagtgttacagctcctaaagatggcacagacccaaagagtgagcagcagcaagatttattgtgaagagcgaaagaacaaagtttccgcagcatggaaagggacctgagtgggttgctgctactggctggggtggccagcttttattcccttatttgtcccctccccatgtcgtgtttctgtctatcagaatgcccttttctcaatcctccaatcttgctggttggtccattttacagagcactgattgatccattttacaaagcgctgattggtgcattttacagagcgctgattggtacattttacaatccccttaactgattggtgcattttacaatcctcttgtaagacagaaaagttctctaagtctccacttgacccaggaagttcagctggcttcacctctcagtagcacatgtcagaatgccctttttaaagggggaataatattccattgttttcatatatattttgctcatccgtttattcattgatgggcaattgggtggcatctgccttttgtttattattaataatgctgctatgaatatagtgtacaaatatctctttgtgttcttggttcaattcttttgggtatttacccagaatggaattgctggtaattctctctctaatctttcaaggacttgccatactgtttttgacagtggctgtagcattttacatttccgcagtaatgcacaagcgttctaatttctccacatccttgacaacatttgttatttccttttttgtttttttttataatagctattctaatgagtatgaagtggtgttactgtccttttgaggcggaacatatggagatgattctgttaaaaaatacacctggtcagccttagaactttaaataagaaacgatttctcaggtttttattatatatggaaaatagcacatagacctacttatggaatgccaaagttattctgaacctcagaccggttcattcattctttcaatgagttatattaaatgcttttactattttcctaccattgtgccaggcaatagtaagggtgctcacagtctggtataaaaaatcaacaactaaacaaacaaggttgccattatagggaaagtctttatggttggagagcatgagagcaaattaagtagcccagtctaaaaatcaggaacaactttctccaggaggtagaactaagttcacacttgggtgaatagaaggcagcaagaagggagaagaaactagaacatattccagatattaggaaccaacttcaaaatttcatttggcctttcctgacagattctagtagttcagagttcatttgctgcccagcacaataaaccagttagtaagttggaaaaatgacttactggttgcctcagaaactcacttttatgcataaaggaaatttgtggaaatgtacttgatcctattgatttaagcatccacatgttaatctggaattttctggcagaggtgtcatatgcccacatacagaattacatgctctctctcccaatacatgcttggctagagttttcaatgaaggaggatcccacagctaatgtggtacaagaaactgtattttcccccttcctgcagcttagaaacacaaggatcctgaagcttctggggcacagacatgcaggcatcacataggtgcaaccaagtatgtctccaaggtggggatggtgtttttcctaggtgcccctgaaaaatgagtgctggagatcaaacagaacacacaatacacacaatgtatcacaaagggttttcatacaagtactgggtgtggaggaaacagcctgggcaaaaccctcaaaataaaagatagctcaactcactaaggaacacaaaataacaaagtaccacaatgtgttggcttaatataacctacatttattttcttactcttctggaggctggaagtccaaaatcaaggtgttaggatcacattccctctgaaggaactagggaagagtcgtttgcctcttttcagcttctggtggtttccagcaatccctggccttccttgtcttgtggcagcatgactccaatctctaccttcactaccactgtgttcttccttgtgtctgtgtgtctccaaatgaccttcttatagggacaccagtcctactggatttaggacccagtctaatacagcattgcatcgacttatctcatttcatcagcaacaaccacatttttaaataaagtcatattctgatgttccaagtagccatgaatttgggactgatgttattcaactggtacaaatagaaccatggaacttcaggctggactatgacttttaacttcttcattcatcaaaaggaaactaaggaaacactgagggagctatttggttgtagtgtgatatcaaatgatatgatctgatgtgcaatatccgaagattattctagctgtatattaataagagacttaaattggggaaatctgtcacgataagccgtgggtcagatgctatgtgaaaagttaatgaaaagtctttcttatttatgcccttttcattctaggcattttttttaaatgcaaatagaacccatacctagtaattttgtagttcactgaaaaatttatgaattttctatattcaggtatagtaacagaagcatcccatgttcacttatttgtgtacttattttgcttctcatttaatagatatgtgctaagcacctatcacatgttaatcaataatgttaggcattgagggtgcaaaggtgaggaaaataatagatatgttcttatagtcaaatgggtatacagtaattataatcaaataaccacaaaacctaaatgcttaattaagagcagggacaagatctatgaagaaaaggtacaaacattttcataagagcatttcaagcacttatgaaatgcaaataggttacttcgtttggtttgtgacattgtgttataataggaattggacaagaaagtttgatcaggtatggtaggcagaattttaaggatggctttcccagatagtaaggatggcttccgagtcattcagacaaacacaaatctagcattgctatgaatggatttcaaagatgtaattaagatcccaagtcagtgagcctaaaatcagaaattatgtagatggtgctaacccaggcaggtaagttctttagaatcagagaattttctctggctagcaccagaggaggaagtcagggagatcagaagcaccagaaggatttcacacagcgttgctgactacaaagacgcagaagaccatgtgatgagaaatacaggtcatctctagaagacaaaactgcccccaggcaaagatccagcaaacaaggaccttagtcctacagccactagacatgaattctgttgacaatctaaatgagcttagagtagatccttcctcatagcctccagagaagagtccagccagacaacaacttgattttggactttttagaccctcagcagagtgttgaaccatgctgtacttctgacttatgaaaactatagataataagtgtgttttgtgttaagccactttgtggtcatttgatgtacaacactagaaaagtaattcagcaggtaattggggatggaagtgaatcataggtaactaatctaaagaattaatgtgctgagaggtcttagaaattgatttcgagtagcatccctttaaaggatttgaagtttctgcttcatttttgggaactcactacaaaccaaagcatatccattttaagatgacacaactacaaatttctttcttataatgagttgacatctatctttggtttccagctctggatccttgttctaggcttgaggattgctgaaagataacactcataaaagctgtggaaagaaaacactcataaaagctgtgggccgatgtgacctacttatagcaaaaatcactttagtattatctgtaaacaacgagagaggcgatgaagggaactgcacgggctacactactttgcgcaagtcacttcttataaaataaaccatttggtctttacaaggtaacagtgtccgttttacatttgaggaaatcagctgggaagggttaagtaagctgccccaaatcaatgagctattaagtggtggaaggagaatgcaatgctcctttgagttgcctgttactatacttgtccttctagaaaaggttatagtttcctggttgagtagtttggggggcattagataaagtggtccatttaatcattgatcggaactcctatatagagggatcaatgtttaaaagggttttgttattttcgtattcgtattttcatccagttaaaaacgttactgttatcttaagaggatatgtatattgcagcaaaggttaagttatgctattgaggcccactgaagagaagaacgtttctcagtcatagaaggtcagcaactccaaaatagaaagacatctgggaaccatttaataaactgattttttcaaatgaagaagataagtaatgcattcaattttatacatagtgccaatcccctaattactccctagattgctctggtaacaggagtgcaagcctgagtcttttgatatttgggggccatatttttggaaggttcattattcttcttcataactattatcacttcccattttacattttgtaaattgtgttctactattaccagttagctttcaccttattgtttggtcagttccattgggtcaggcactattgacatttatccagttttctttcttttaattccctcagtataatggctttgtcattttttaacaattttcaagaattatttacctggagattgatactttgaaaaactgaaattatcttctcctgtggagtaattttagtcagcttctatttaaatagataaaaggcccaatcatttgctttgaaatttgtccataacatgtatgcatgtgatgtgttaatttatttcattacagtggagtaaaagcaaaaagaaacatcacctttgttgaacttacaggatgctcttcccctttaaaaataaagctcgtgtttatttacagtaggcaatgctagttaagtcttggtaaagaggagaaccatgcatctgatattggcatacctttggaatgaaacatagtacatgtttaaacatatattcctttgtagctgtttctcttctctattcctctctctagacaagagatgaaaaatagattgtactctgcatgccacttctaatccattgattaggaatggctttcaaatgaaaatctgagaatcattctgagttcagggccttgttcaggagtgaagaatgtcattcatgattgactatcaagagcaccagagacacagaggaaagtgttggcatgcacaccgtgtacccacaatctcaacttttcatctcactgtttggaaggaggaaactggatgtgggtgttgtgaaaagccctggctcatctgatgattttgccaacctaaaatcaaaaaaaaaaatcaaatttaaagagagattatttgagcacaaagtttgaggacagcccacccagaaacaccaactcttaaagaatggaatcagcatcccaaagtagggaagttaaggcttcctttatataggcaaagacaggggagtttttagcaggattacaacattttttatacgaggttggcacatagttgtagcaatttaattggtgattggcactgtttcttttgaggaagggtaattttaacaaattttaatagaagctgtaatagtcatgggctttctgtcatctagtctaagcaaggaagaacaacaaaggggaaattaatctatatgaaggatcattaattaagaaggcaggaggtttttgtccctgacttcgtttaattctctctagtcattctataggacaacaaaaatgacaaagtgacttaatatgtaatctgagaaacagaaattataaccataagttataatttctcagatcacagtcaaatctctctcaaggcttaaggttttgaggggttccaacatcttttaaattctatttattttcacaatttctaagtgtcctagtctgagatgggaagatccttaccacattaaaaatcttcaagtttccagccaatgtactgagtgctttgcataaacaaatccaattaatccttcctacaccccataagacaggtaccatttttactttattttatcaatacggaaacaaagcacagaagttaggtaacttgttcaacttaacactgctaggaagaaacagagttgatatttgaacccacatagtttgagacttgcatcctcaaacaccccactaaactgaacacattcagtttttcaatcattattcagattgttatcattagaagatattaaaaaagatcaaattggttttaaatgcaattttggtaagagcctcatttaaatgaatgctattatatcatttcaaaacaatagtaaacatttcatagaactttttatcccagtatagccacaggggtcaatttcatagctttcctttgtcagttaatgtcagcattactcttttgttgaacttgaagaactaacttcaaactctgccactatattgttaatcctccacccccaattaaatatccttctcatgactatagttatatcaccttgccttgccttatagtgtatgattttatgatgatcatcaaatcctgtttattaagggcctctcatttttgatatcctaaaataaataggggaaacaggcacagttcttgtctttttgaaccatggatgctttggtttacttaattttcattttaattttataaaggaccattcaacatgtattaaagcataatgattttttcccttaatttgagaactctttgcaaagatagggggagatatgcattctattggactatgtgtttggatgtggaacccatgtatacgaaaggccaactgtattttctctgtttactctcaggtaaagaaactcagtaatagagggatcagataacctgtccagaatcaaataactagagaatttagagccaagcttcagacacagacagtgtgactcaaaagtccaaattctaagcaatttttctacattctctcttaactctgtatgtattagtccattttcacactgctataaggatactacctgagacttggtaatttataaataaaagaggtttcattgactcacagttctgcatggtgagggaagcctcaggaaacttaccatcatggtggaaggtcaaagagaagcaagcaccttcttcacgaggaggcaggaggagagagagagcaacgaagtgccacactttaaaaccatcagctctcgtgagaactcactcgctatcacaagaacagcaggagggaaaccacccatatgatccaatcaactcccaccaggtacctccctcaaaacataggaattacaatgtgagatgagatttgggtggggacaaacaaccaaaccatatcaccacactttacttctctgtcttcaaaagaataatcaggcagaaatacttaaagattgcagaatcagagaatatatcaaaaacagtagtaagaaaattggatagcaatcgaggtacacatggggaaaaatattggatgtctgggaaatgtcgactgctgatcagggtgaaacaggaagtgattgcaagtttttgatgaggggtcacgtgcaagagagactttaagtacaagatagtatgagcaagagcacatggtctaaagtacaagaaattgtggtgtcactaaaatataattatgtctccagatgagtggtggtattgaagtttttcatccaaactttctttccaagcaactgttaaagaaaaccagagttggatgttaattaaagtagtaaaaacaggctttagttccaatgggggaaagatatctcagtatagagttgggctcaattccaaatacagcatggataagtgggaatctacagccaaggaacaagttgggggtcagcggatgaaacactactaagaaaaaacattagggataggggaagataatagttaaacagacctaacctgattcttgctgaaggcaagccccattgatcagatatcacctggcgggtggtgggggtattctctctaaattggcttagcaggattattgccaaagctgaatgatgcaaagacaaacacagaagcccaaaggttgaagtctagttggaagagggttcagaggagcctcaccaatgtttgatcaaggagaggtttgttactatcttgattaagaatcaagtttcttaattatctttttttctaaagctggattattggtttgcattcatttttttctactagattcttagtcggctttccatttttgtagtgtcttatagagacaaagttaggaaaaatatgctatgtcagggctcagaaatgatatcccaaaatatggcgtcttggcatttgagaaaaaagcaaaagcaggaaggtctttctgactttcccctcacccttcttccctgaagcaaaactgtaagatcttctccttcacttctttcctaaagaccctcatgtgacaggtgtcctactctataccaagaggataaagtgtcacacaggaggccaagaacaatctgaacaaatagaccatgctgaattcccgtcagtttattaccatcagattataccctggtgttctccaattacatttttgtatgactggccataaaaaatatacttttccctgagtcttttggtcttcgtttctgaaggctgtcatgtcatataaattttaagttcatttatatgcttttcatttattctgtttcgttataggtgtgtccgccatgagtcttgcatggggtaatgaaaagacagtactttttctcccctataatttctggcacccaacacgaggcccaaacccaccacccagagatggagtcttatgctctatcactgagctagattcacctgcagcattttcccctctacagcagttatataaaaacacctttaaaagtttgccaaaatattttatcccatatcatacttggtgatattagaaaaatatgcttgatatataatagctttctttacaaatgacaatattttacatataatacatattttacatatgccatcaaagattttagcattataccaaatacatctgagcccctgtgttagaaatgagaattgaggagctaatttccaatacatttcttggcatagttttaactatttttaagtgaactgaaatcattttgaaacctaatctcctcactctccaacacatttatctatgtaatcttttaaaatttctggttttaatgtggatttataaagtcctgagtattacataaaaactagtctttgactaaagttgatgatcttatactcagtacaaacatatcttcaaactctttgagagaagattcctattagtgtagctgtcaacaacctacaataaagttgaatagaaagtacaattatgtgatcagtgcaaaaaaaagcaaagaaaaagaaaaatttgtacagcattatatatctcttctaaaacgcacttgattaatagaagcaacatactcaaatatttctctaacttgtaacaaagaagtttacaacaaccattcttgttcatttaaaaattaaattcaaaagaagcagaaaaaacctgaagaataaaaatgacacaagggaaagaaaatggaaaagttatttattaggaagataataatggttaccacttttatggtgctttatgcctgtgaatttcaaagctcttcattaaatgttagctcaaaggacttcacacatgttgtttcacttagtccttttctgctgggacaattaaagaccataaaggcataaaatgcaataaaagtcaccacttcagggggcaaaaacacaatgggtatattctgtgccagaccatattcccaataagcaggattaaattgtggaatatatacgccaggttggctctccacaggcatcacctgggcagtgatgatcactctagtaaatctggggctgacgacgggaagaaactcgatgaagaaaaaaaaaaagaagtcacaggcaagtattaaggataataaatgaacgggtctgttgggggcattacttcctcttgtacatcaattaaatatgaaagcagtagaccaacgtggtttggaatggccccttttgaattcttactctttgtgaatacagttacaaaagaggacctctgaggaagagtacttctctttgactgagatcattaactcccagcgcagaggctaggagaaaagaggatttagatttggactccaaagagaatttaaaagtacatccaatttccaactccccctaggtggttttcagcaacgaaaaactgtggagttttataatgtcagtaagtattaataagcttaaatgttcactgaactaaaaaaagtgaaatattagggctctacagagtagggcttggacagtgcacttgaagcatatgctcaaatcactttgaaagtttactgtctggtaaggaaaacacaaagctaacaaacacatatcatgtgctaatgaatataatttgggaaaaggtataagatattctattggcagtaacatctctgggacagttcttagatggaatttacacctaaaagcttcaacaattaattcttgtcaaaaacatcttggaaccttgaaattggatatttctataatcaggtcccatttaactcctccctgaagctacaccaccttctatgccctttattcatgtatatacatggaatcatcccagactttatttattcatttattactttttctgttaataaacaaggtcttgctctgttacccaggctggtgtgtagtggtgtgatcacagctcactgtaacctcaaactcctgagctcaagcgatccttcccacttcagcctctcaaagcactgtgattacaggtgtgagtcaccaatcctggcctttttttcatcaatgatagttatttttaaaaaatgttttttagtctgttggaaggatgtaattactttatgccacaacaataagtggtaacctcattgtaaagacagtggttaaagttggttgccatagcctcaagtttcccagctgctacccttatttcctcaatagtctattcttagcccagcccccagggtgtcctttctaatgtcctatcacatacagccagagtcccccactacaggtcttgaggatgaaagtgtccaatttctgaatcccacgacctcggtttttttccttctctcccagctcctaaacctcccaaggccaaagccaaaggctttgaaagccaagaaggcagtactgaaaggcgtccacagccacaaattcaagaagattcacacaccactcaccttctggggtccaagacactgaggctctggagacagcccaaatatcctcggaagagcacccccggaagaaacaccagccctggagaaacattcccctgaccactgagttcatggtgaagaagagagaagacaacagcacacttgtgttcattgtggatgtcaaaaccaacaaacacaggatcaaactggctgtgaagttctctgacgttgatgtggccaaggtcaacaccatgatatgtcatggagagaagacatatgttccattgactcctgctatgaggctttggatgttgccaacaaaattggaatcatctcatacacccagctggctaattctaaatatatatcttttcaccattaaaaatatatatttataatatcatgtcctatttctcctcagctcaaaacccttcagtggcactccattttattggtgtcaaagccaaagtcctttcaatggtctacaaaacactgtttggccaggccaccaaataccttgctagtttcttctagttctattctctctcacttggctccagtcacactgacctccccgccattccttcagtgcatgggaatatcccaccttcagaccattgctccaattcttctcattttgggaatgttctttacccagataatagcttgactaactccttcttttatgtctgacttggctcaacagtttaatctcaatgagacttaccctgaccaccctatttcatagttccaacctggattccagcattcctaatccccttactctgcacgacttcttttttttcccatggtactcaccacctctaactcattagatcatttatttagtccttaagttgactatttattatctgcctgcccagtataatgtaagatcctcaaaggcagaaacttgtctcttttgttcacagctcctagaacagtgccggggacataggaatgcctggtaaatatttgctgaatgaataagtgaatgaaaataacctgaaatgaatatatcagcatttaaatcttacttcaccctttaatcaaaggagcaccagccacatcctgtctattaagtatcattgggattggtcacctgatgatttgaactttctaggtttccaggtctacataacaataagcactcacaggacatattcattgtaaatggctctttcagcttggatttgtgagagataatcacgttgtaggattcattgtctctagggaaaaaaaagccattgaattacatgatgatccctgcctatttgtctatttgttggggttgacatttatatttcttttatttgtactttcttgtgcttaagctgttatttaaaaccaaaaataataggctaaaacaagccatcaaaaagcaaaggcatattgacttaatttggtatgcccataaatcatagttctgatggtgatctacttaaaggtttattttcagtggggggagattttcttttaacagggaaatggtccatgtgctggttatgtaattttaattaggctataattattcctaatttttctgtaaatctgaaaataaaaagaaacatgaggacaagacttcctactggggatcactattggattctttatttgaaactactgatattatgtgatcaggcatgggtttaatggcttgagataataggtaggtcacccacacacatgctttaggtatctgggaagctatgagcataaaaatacataaaggtgctgatgtttattataaatcagataaataataaatcttatagaagtacataaattattgttttctaatacacatacacagatgtatgctattgtgtgtaataagacaaaatttttttgacattcaaaacctaaccttataacttgtagctcgcactaaggagtgcctccctctcagcatggacaaatccaaactcgcactctttactatcaaaactgtccgctgctttctcaggctgttaagagttttcaacagaaaaactaaacctgattattccttaattttttcctcttctcattttgtaacagttaatttcccctcaaatcttttgcagctttcccttctctctgtcttggttctgcttcatagcacttggtttgtaagactttctcccatatagaattcctatctccagcctctcccccatcaatccaaccatcccattatcatggaagttatctttccaaagctaaaatctgagcatgtcctactccatactctatactcactggtgcaacatacacttatttattctcggaacccaacttatcttttctctcttgctccctccatcttcctgttttcccttgtcacagtatgctattcccagaatggtttgtgatgtctcctgtctgggtgtttgtgtgggcttttcctctgtcccagaaagcctatctctcattcatctcccaagcatgcctcaaatatcacttcttatcttaagccagctttattccaactgccactgacagggtttgccttcctccactgtattcccattcagtgtgcgcttctcaccttaggtttcacgtttctctccatgtgtgtataagaatatatataccaaaccttgaaactgcttatttatacacacacatagatctctagagctctagatctgtatccaatctatcagtatgtaatagatcgttattcacagatgtcgtatttgcaaattcacctgtattgaaattcatttgtaaacccaaaatcaatgctcgctgcactctttccaggccattcccaaaatgagcaaagaggagaaacatttgagtcactcatactgcacattcccagctgaggtggaataaggtaacactccactttcctgttttgggtctcatactgcgaacaagtgtttctttcctggtacatctagtgctccattttttttttttttttttacatttttgtgatttttcttggtgatttaagtgtttaaaatggctcccaagcatagtgccgaagtgttgtctaatgttcctaaccttaagaaggctataatatatcgtacagagaaaacatatgtgttaggtaagcttcattcaagcatgaattacagcaccgatggcaatacgttaaatgttaacatatataaacgtttaaattcatacaaaaatatgtattatataatctatctttaagcagaaacacaaataaggttatatattgatcaactgataaaaatgttataactggaggctcataagaacttaatctcatattttccctagaggcaaggatcagtatttactgtttgcagagactttataaattataactaatgtgaattacaagaatcaactgtatatatatgtatatgatcgtcccttagcattggtcggggattggttccaggatccctgcaaatactaaaatctgcagatgctcaagtcccttatacaaactggcatagtatttgtatataacctatgcacatcctcccgaacactttatacaatctctagattacttatagtacctaacacaatgtagctgttgtgaaaatagttgctatattgtatttttatcattttttgttgttgtattgttacttttttattattggtgttgttttagttttgttttttttttgtttgtttgtttgtttttttttttgcctgaatagttttggtctgaagttgattgaatctgtgaatgtggaacccatggatatggaaagctgcctgtatatcctttgcaagcaactggtcctcactcttctctttatttctagagtccagcagggtgcctgacatgtagcagatattcgatatatctttgaaaacaaaataaacaaaggaaaatgagacatgaagacattttagttgcaaagaagaaacttgcctttattgatttaagcaagaatcaggtttacaaaaaggcaattgtcagctcagaggagagctaggaaggctcaaaatggggcaggtaaaataagcaggagaaaatgaaggataatcagccagagaccagccagaatcgtgccccagaaacagtgtggtggggctaccagtgctacaaccactcaatatggcactccacagcttataccactttcatcaccagaatgaaatgtggccattcatatctcccttctgatgtcccccagaagtgggatttttcacaatccctgctcttgtgttttattatatctagatttaaattaccatatgggtaaggttgatgggtgagcctggtcgcatgcccataccctagctggctttttaatttccatagtaaacagagggctgccttctgctagaacccattcagacatttccaaaatatcagaaagatatggagtgtttcagatgctggtcaatgaaaacaataacgtgtaatgcaggttttttttaatctttaaacacccttgcattagtcctccatctccaataatgcagaaaaataaaaatcctccagaatatagtggctcccaacaatagcaatttaaggctcactcctggttctgtgaatcagctgtgactcacagggagttgcctgggggtttgggttcagatctgttccacgtgtctctcattctggcatcagtgattacctagggcaaaatcttctcaaaactgatagcagaagtaaaaaggccagtcagaaccctagatgtgctaaagcctctgactgcatgaacatagtcagtaaagttcattggctaaagcaaatcacataccaagcccaacatctgcaggcaggacatattattcacctactctggtgggaggtgctgcaaattcacatggcaaatgtcttggatgtttaattctatcacaggaaggaaataaattgggaataacaagcctgtctactactgtagtaacggaagtgttctaattttgtctagaacaattggaacgctgctgttgatattgtcaatattactgaaatcattttggtttataacattgatgtactaacattcactgtcccaagtgatcttccctttctgtcctaattgtatttaaaatatttttcatgacaacctccctccacctaatacaactcctgttttccagtctctcttgcttgctaaaaatcaagttgaatattaaggaaaaggaaattttatactttgtagtttgaagcatgacctaattttcaatgctttttccaaagggcaagcgaggtatataggggacacagccatacaggctctaaatagggattgcaaccagggctccacattagaatcatataagaatcacccacgagagatttgtttaaatgcttttgctggagggctactccgtatcaattatatcagacactgaggtagggtccaagtattctaacaacatctccaagtgatttgtaagcacattaaagtttgaaaagcgctgctctacagtaaaacggttggaattttaagcctgatataaccacatgtcggtgggttccaagccatgttgtttgacattttatttcctcattcgagaaattagaataatcaaatgtttaccttgcatacttgttcaatgattgtgaaatgtaacaataatgtaaaatatagaatgagaggcatgtaacgagtacaggataaaaaatagtgccttactagtattattatctcaactttggcctctccacggccttaggcaaattaagtttcctccccgggggaaattttatcatgtaaaatgatgaatgaaaattctctgattttcctttcttttctaacattcagcgatttcctggtatcccctagaagttattattccattattgtagaaataggttatttctttgcatgtatgctttaacataaggattaaaaataatagcaaagaaaatgtatgacatctctttttcttgagatatcttttgtgatttttttttctgcgttgtggaatctatgtttagagacatgcaatgtttaaatgtgatttggacagaaaggcaaaaggaaaaaaatagtttctatgtgttattagcctgggttatctagagaaatagaatgtatatacatataagtatatatgtataaatcataaggaattggcttgtgtggtaattatggaagctgagaagaactatgatctccagttagcaagctaaagacccaagaaagccagtggtacacttgcagtgtgagtctgaaggcctgagaatcaggagagccaatggtgtaagtttcagccccagtttgagtcaaaacctgggagaagaccaatgtcccagttcaaagataggcagagaacgaattcttccttcctctgcttctttgttctattcaggcctctaataaattggatgaatcccactcacagaggaaaggaaatctaatttactcagtctacagattcaaatgttaacctcctccagaaacatccttacagaaacaccaggataatatttaaccaaatacagtcatgcattacttaagtatgggacacattctgataaatgcttaattaggtgattttgttgttgtgtggacatcattgagtgtatatacacaaacctcgatggtacagtttactgcacacctaggctatgtggtgtagagactgttgctgctaggctacaaacttgtatagcatttgactgtattgaacactgtcagcaattctaacacaacggtaagtatttgtatatctgaacatatctaaacatataaaaggtacaagaaaaatacagtattatactcttatgacaccacagtcatatatgcagaccaccatcctggactgaaatcctttactgaaatgctttttctttccgaattttactttaggttaagggggcacatgtgcatgtttattacatgagtaaattgtgcattgccaaggtttgctgtacagattattttgtcacccaaatagtcagcataatacctgataggcagtttttcaatcctcatcctcctcgcaccctccactcgcaagtaggcagggccctagtgtctgttgttcacttctttttttttttttttgattcggagtctcgctgtcgcccaggctggagtgcagtggcgggatctcggctcactgcaagctctgcctcccgggttcccgccattctcctgcctcagcctcccgagtagctgggactacaggcgcccgccaccacgcctggctaattttttgtatttttagtagagacggggtttcaccgttttagccgggatggtctcgatctcctgacctcgtgatccgcccgcctcggcctcccaaagtgctgggactacaggcgtgagccaccgcgcccggcctgttgttcacttctttgtgttcatgtatactcaatacttagctcccacttataagtgagaacttgcagtatttggttttctgttgctgtgttaatttgcttaggataatgccctcttgctccatccatgttgctgcaaaggacatgattttgttcctttttatgcctgtgtagcatattatggtgtatatctgccacattttctttctccagtccaccactgatggacatctaggctgattccatgttttcgctattgtgaatactgctgcaatgaatatttgtgtgcatgtctttatagtaaaatgatttatattcctttgggtatatacccagtaatgggattgcagggttgaatggtagtactgttgtaagttttagagaaatctccaaattgctttccacagtagatgagctaatttacgttcccaatagcattgtgtaagtgttcccttttttctgcaaccccaccagcacctggttttttgctttttttgtgttttttttttttttttttgactttttagtaacagccattctgactgatgtgagatgctatctcattgtggttttccatttgcatttctctaacgattgatgatacagagcatttttttcatatgcttattggccacatgcatatcttcttttgagaaatgtctgttcacgccctttgcccatttttaaatgaggttctttttctgcttgttgatttaagttccttataaattttggacattagacctttgtcaaaagcatagtacgcaaatattttcttccattctgtaggttgtttgtttattctgttaatagtttcttttgctgtgcagaagctctttagtttaactaggtcccacttgtcaagttttgtttttgttgccattgcttttgccatctttgtcatgaaacctttgccagggactatatacagaatggtatttcctagttattttttctagaattataatagttttaggttttacattgaagtctttaatccatcttgataaaggaaatagcccagttttaatcttatgcatatggctagccagttatcccagcaccatttattgaacgggaattcctttccccatcgtgtgcttttgtccactttgtcaaaggttagatggttataggtatatggcattgtttccgggctctctattgtgttccactggtctatgtgtctgttcttgtaccagtaccatgctgttttggttactgtagccctgtagtatagtttgaagctgcatagtatgattgatgtctctggctttgttctttttgcttaggattactttggctattcgggctcattttttgttccatgtgaatattaaaatagtattttctaactctgtgaaaaatgtcattggtagtttgatagaaatagcattgaacctgcagattgctttgggccgtatggccattttgacaatatttattcttcttatccatgagcatggaatattctcccatttgtttgtgtcatctctgatttctttgagcagtgctttgtaattctcattgtagagatctttcacctccatggttggctatattcccaggtattttattcttttagtggctactgtgaatgggattgtgttcttgatttggatctcagcttggacgttattcatgtgtagaaatgctactgatttttgtacactgattttgtatcttgaaactttcttgaagttgtttatcatatctaggagcatttgggcagagactatggagttttctaagtaccgaattatatcatcagcaaagagacagtttgacttcctctcttcctatttggatgtcttttatctctttctccttcctgactgctcttgctaggacttcctgaaatgttgataccccatgcaggactgcatctggacacaccgtagaccagtcaagttgaaacataaaattaaccctcacactacgtgatatcattaaatcaaacttcctccctcttgaagcttctcagacttccaaacctgtagagaaacatttgctaagttaaagacatatgttttgccttatgttgcagttttcttcagtttttatctgtttctgtacaggttgcttattattgaaaatttttatccacaaaggtagttattgggtatccaatcttcatgctgtattttagttctcattttatgtttgccatccttcatggtatcaacatgcagtagaattactaacataaattagtaatgcatttttacatgttgttagtaattatcttatttcttactatgattaccatgtcataaataacatattgaatattgaaatacatacattacaactagaacgtgatctcccaagtgacggaaaacttgcctctcttatcctccaagcttatagcaaaggaccttgtcgatagtagcagttaatatccttaaatgaataaatttaatttttccatctctatgactaagaggccatatgaaatttaccaatatgaaaattgtatcagttctctattactacaataatgttgtgtaataaaacaatcactgtatctgagtagcatagaatatacattgattcctcacatatgtgcaggttagccagtcaattcatgcaggacagattgagtaggaacagctctgctcctcatgcattgatcataggattcaggatcaaagagaagcaactacccaggagaaccttttctcttggtagtgacagaatgcaagacagtaagctaaaacacagaaggcctcttaagacctaagattaaaaatggcatgctatcctccatccacatttctttggctaaaacaaggcccatagtcaagcccaaagtcaaggacagaagtaatacactctatccacaattagttcatgacagtggtgcagatacaagagagggggaaaagagaagaatgagagttagtaatttaatctacctaaaaagctgaagttggccgggcgcggtggctcacgcctgtaatcccagcactttgggaggccgaggcgggcggatcacgaggtcaggagatcgagaccatcctggctaacacagtgaaaccccgtctctactaaaaaacacaaaaaattagccgggcgcggtggcgggcgcctgtagtcccagctgcgcgggaggctgaggcgggagaatggcgggaacccgggaggcggagcttgcagtgagccgagatggcgccaccgcactccagcctgggcgacagagcgacactccgtctcaaaaaaaaaaaaaaaaaaactgaagttaagagaggtcatttaaagtcgggcacagtggctcttgcccgtagtcccagctactcacgaggctgaagcgaggagattgtttcagccaaggagttcaaggcagcagtgagctatgatcgtgccactatactacagactgggtgacagagtgagactctgtctctaaaagaaaaaaaaaataagagatgccatttaactttacaagatcaccaaattagttttccctacagccaatacttgaccccatattgccgctgactccaaagtttttaaacacttcactatgctgtgatcaagaatccacaaagaagccatttttggtaacttggtaaatattataccctctttttttgcagtgagtttagtacaagaaatataactaaattaaaacacaatgcatctatcaccttgttgagtatggggatcttacagctgcaaaggatttaattaaaagttgatgatttaataggcaggttccatctattgtgtactctggagggtgagattcaatttaaaattgggttccaaatttcattttggaacagcatacttgtcatcggctggcagaaaatatcccaaaggaaacagacatgtccctgaatagggagcactgaatcagacagccaagagcagctaaaaagttaaacaacaaatattttatgtactttggttctggttctaggaagttctaggcattcagttgtagatatttaattgcaggttttttgcccacttttctcatgccaattgttcttaaaacatacatttctttggataaatacgatttttgtatctattttttaaataacaccatcattccttgatgcaacaaaatacaagttaataaatactgcaaagctaaaaaatcccctgtaatttttagtcaactacaggttgagaatgagaaaggaatacaggatcattacttatgttacaatctcaaagtaccacaaggtttgggccttgacttcatctcagaaatgttctcaccttttaaaatgctctttctcttagcaataactatgttatgtggtaagtgtcctctactttcgcatttattgtctgcctgaaattggtacacatttatgaaatcattattcttgctgtctgatctacaggaaactagggatcattaactacccctagtagctgattcttggcttcctttcttaccatgaaatatccttaaattgtaaagggtttgagtttatagatagaaatttgtcaatctctcttttccaaagaacaaaaatcacaatgtgttgaatgaatattagtgtatttgtttgtagatgcacactctcatgcaccactacatcctcaagtgtatataatacatctagagaataactaccaatattttaaaattagaactttgccttccctgtcattccatttttggcaagcatttaaaatgttgattttctacaaacctgaagtgtgtttgttttattgccagagaaatgtacaagttatattagaggcaaaagattaagatagtgtcttttacaaataggccaacgagattgccatgctgggataggctcatttccaaaggctgtgccatcattcatgatggctatgatctgcctgtgctgactgccacctatcacactgccaagtgttccctgggccagatcatcaccaccaatgctgaaaatcaagttttagtcttcctaatttccaaatttccataagtagtgtcaacattttaaaatctctccaaataaagtggtcttgcatgtgtgaaatcacagagtcagaaagagctttatgatgttgccttcacagaaccagatgcaaattaacatggcattgctcttaaaatgtaatggttgcttccagtgctgcggcctacaatttgcgtcccagaatggaagcttcaggggcccctactgtgaacaccagccacatgtcaaaataactgaggtgacctttcaaagccaccaattttgttttctcttaaaaaataaaaaaaggcttttcctcatgcagtatgactagtagtcaagccaggagctaataaaaaaaaatcctggaagaatatataaataggaaaccagaattataaatagaatcaaataattctgtattcaaaatttgcttttgccacttacaagctgtagacccatgggcagagactgttagtgtttagttccttttctgttaaatacgatatgaattctggaggttagcatttattgcacacttactatactgacacatatgcagagtgatttgtaggtattttcttatttactccattcaatgattatagaatattaatactttccccattgtttacaaaaatgggcttacagaagttaagcaaaagcacaggcagaattaaatagtaaatgcatagtatagcatatgagtcagttctcacactgctataaagaactacctaagactgggtaatttataaagaggtttaattgactcacagttccacatggctggggaggcctcaggaaacttaccatcatggtagaaggcaaaaggggagcaaagcacattctcccatggcaaagcaggagagagagagagaaacgagaagtgccacacacttttatacaaacagatctcctgagaactcactcactatcacaaaaatagcaactgggaagtctgccctgataattcaatcacctcctaccaggcccctcccctgacacatggggattataatttgacatgagattagagtgacacagagccaaatcatatccttccacccctagcccctcccaaatcttatgtctttctcacatttcaaaaccaatcatgccttcccaacagtccaccaaagtcttaactcctcccaacattgactcaaaagtccaaatccaaagtcacatctgagataaggcaagtccattctgcctatgagctgataaaataaaaaacaagttcgttgcttccaagatacaatgagggtacaggtattgcataaatggtcccactccaaatgggagaaattggcctaaacataaaggctacaggccctacgcaaatcagaaacccagcagggcagtcaaatcttaaaggtccaaaataatctcctttgactccatgtctgacaaccagggcatgctaattcaagaggtggacacccaatgccttggactgctccacacctgtggctctgcaggataaagccctgttttcacaggctggtgttgagtgcctgtggccttctaggcacatggtgcaagctgcccatgggtctaccattctggggtctggaggtcagtggccctcttcccacagctctactaggcagtgcccaagtggagattctgtgtgggggctccaacatcacatttcccctccacactgccctagtacaggttctccacgagggctccaaacctaccacagacttcagcctggtcatccaggcatttccacacatcctctgaaatctaggcagaggttcccaaacctcagttcttgccttctgcacacccaaagacccaacaccacatggaagccaccatggcttcaggcttgcagcctttgaagccacagcctctgaagccacagcctgagctgtacattggctccttttggccacaactagagttggagcgtctaggacactgggtactatgccctgaggcagcatagagcagtaaagccctgggcctggcccacaaacccatttttcccttctgggcctccaggcctgtgatgggaaggactgctatgaagatctctcacatgccgtgtagacattttctccattgtcttggctattaacacttggcttctcttaggcaaatttctgcagctggcttgaatttcttccccagaaaatttgtttttcttttctaccacatagtcaggctgcaaatttaccaaacttttctgctctgcttcccttttaaacgtaagttccaatgtcagatcatctctttgtgaatacatatgactgtatgctgtcaggaccagccaggtcacctcttgaatgctttgctgcttagaaatttcttccaccggataccctaaattatctctctcaagttcgaagttccacaaatcgctatggtaggggcaaaatgccaccagtctctttgctaaagcatagcaagagtgacctttacttcagttcccaatacatttgacatctccatttgagaccacctcaacctggatttcattgtctgtattactatcagcattttggtgaaagccattcaacaagactctaggaagttccaaaccttcccacatctttttatcttcttcttagccctccaaactgttccaacctctgcgtgttacccagttccaaaatcgctttcacattttcaggtatctttatagctgtaccccattcccagtaccaattttctgtattagtccattttcacaccactataaagaactacctgagactgggtaatttacaaagaaaagaggtttaattgactcacagttctacgtgactggggaggactcagcaaacttatcatggtggaatgcaaaggggaagcaagtcacgtcttacatggcagagcagaagagagagacagaaagaaataggaagttccacacactttcaaacaaccagatctcatgagaactcactcactatcattagaatagcaaggggaagttcgtcccatgattcaatctcctcccacaaggcccctcccctgacacatggggattacaatttgacatgagatttgggtggggacacagagccaagccatattatatagcaattggttcatagcaggcgttcaggaaatactagtttaggagattccattcttccactacttaaaattcttcttaagctgctcatactaatgtcattcagtgttggtcttctaaaaatattagttcagccatctttagcttatggatctgactattccagttactttcaatttcaaggagtccaatatatgttgcaaaaccagaccccttgcacattaatttattacaaaatatttactgatcatctgtagtatgttaggcaagggaaacttagtagagcaaaaaatagttgagctccttgctctcatggaacttaattcgagcagggaaaatggaaaacaaatgaaagaaatgagacataaacaaggctgaatgctgacaatgggagagagtgccacttcagatgcatggccagggaagacttcatttagggatgtattataagtttgccaaggctacacaggaaagtagcaaaaaccaggtggcttaaaaaacagaaatgtattgtctcacagttctggaggttagaagtcctagattaagccatcatcctgcatggttggtttttttctgagggctgtgatgaagactgttccaggtctctctcctagcttctggtagcctcaggcactcgacctgtagactgcaccctccacgtgtcttcactgtctttcccctatccttagatccatgtccaagtctccctttttataaggacaccactcatattgagttagagtccaccctaatggcctcattttaacttcatcatctgtaaagaccctatttccaaattaggtcacatccacaaatactgtgggttaggacttcaacatctttggtggggggcagataaaatccaactcataacagagggtgagatttaaaatatgtgccaaagaataaatacctgtttggtgagggagaagcatgctaggtagagaaggagtaaaaaggacttaaaagtactcactaaaaacaggtaacaaaatgttcacatagcactaataagaaacccaaattggaaactaaccaaatgcttatcagcaattggatgaatacactgtagtacagtcacacaatggaaaactattcagcaagattcagcaaaccacagatcttgggccaaatgtagaccactgctggttattgtaaataaagttgcattggaacgcagtcgctacctcaattcatttatacattatatatagctgttttcactctataactcagttgagcagttgtggcagacaccacatgacccaaaaaactgaaattatttactatctgccccgttttaaaaaaacatagttttcttacctctacttatagcagataaaagatcatttaggaatattacacaataacatgaatgaatctcacaggcagatacaatttcatgccaaacaagttcaacacagaagattagataatatacgacctatttataataaaaaaataaacaagcaaaagtaatttctgtggttagaagtcacaacggtgattattcttgctgggataaagttactagaagggaggtagtgacaggagagtgtagggtggtggggtaggagagcaggggacagggggtttggggtttccaggaatgattgttcggtttctttatccaggtgcttgttacatggatgtgttccatttcagtttgtgaaaattcatggagatttgtacttatactcaattttgtgtccctatatagtaaaacgttgtttttatattttaaatattaaaagtaaataaagatagcaagctttgtatatttctagaactaaaaagaggctgaccttggatatttgaaacattagatatattggaattaagattttaatttgtgtgattgctgttctttattcagagctgaaaaaaaaagaactttcctcaatgatggacatgttctacttggggctgtctaattcagcaaccactagtcatatgtgtctgttgagcacttgaaatgtaactgctgtaactgagcaactaaatttaaattttatttaattttatgtagttattttaattagttcaattttaatttatttaaatttaattagtttaatttagccccatgtggatggtggctactgtctcgcaggcacagctgtctctatcctatggcacaactctctatatcccatgcattctcctcaccttgatctaacccccacatcctttctcaggttcatgctgtgtaatatctagaaaaataaaaataatctcaggttctatcatactccaaaaacaagtgcatctaatgtttttaggaaatctaaaattgcttttctaatttgtgcatgttttattttcatagggtgtaaactgaatgactaataaagagcatagatttaatggttccttgggtttattagctaacacacttgactttaagattctcttgcctattacaactttataaatctttttaaaagggtgttgttttaatgttgtatatctgtacagatataggaaatggaaaaaaattaccttctgaatcagttgtgccctcaattgcagtagtgttaatttgaggcatcttctctttggtgccaagaaaataacagataatagatattgtacattgaaaagaaagttatggtgttcagaaaggccaaatcaatggaaaattctaagctttatgtggataatatacctcaaacataccttttatggacatttgtaaaagtattttaatgatatttttaggtgttttatgtttccaaaacacatacagtaatcataaaatgttcattcaaacatcatttcaaatatagacacaaacacatttataaaaacaaggaaagagaactattcaaatttggaatagccaatcatgttactatgagggtttaccacttcgaagttgtcagcttaaagatacacttctgatttgggacagacttttttaatataaaagtttaaattaagataatctattaaattataactccttgaatcaaaaaaaaatccaatgaaatcacctttggaagagttcattttttagattaaaggcaaatgacaaaagtaaagaagttaacaccataaatatatctaaataactcttattgtcttatatatgtctataaataaatagtgatatatgagaatcagttggtagttctttttctgatactctaaaatatttaagtgtcctctaagcaaaaagattaaaatgctgcttcataaagtttgttataggagtcatattgtgcttcaatttttaaaaatcagcttgtttctgtggtgctcattatgggtgaaaattttgcgttatgtcaaattcattaaccatgtcctgaccaccatgtactaacaggaaagtggtggggtggcggggagtgcacacgcatgttcatgttcactcaggggatcgcatgtatatatttatggttatgtggaaacagtgattactttctgtatttttaggtgtggtgggaaaaactgacgaatgatctgtctctagaagttctgataatacatgcagtctattgatagagaaggacttcccagatgaactgaagcattttttagcatcagtttataattctctgactccatcttcaagcacacttagaatagattggatgcagttggatcccattatataatccattagtgattaaaaatgggttagcaggccaggtgtggtggctcatacctgtaatcccagcactttgggatgctgaggtgggtggatcgcttgaggtcaggagttagagacaagtctggccaagatggtgaaaccctgtctctactaaaaatacaaaaattagccaggcatgatggcaggtgcctgtaatcccagccactcaggaggctgagccaggagaatcccttgaacccaaggggcggaggatgcagtgagccaagatcgcaccactgcactccagcctgggcgacagagcaagactgtatctcaataaaaaagggggggttaaaagtccttattttttttctgaaatgaccaatttactgttatgaaccattcaaggagtgctggtgaatatcacggagccagtgaacacgccaaagaacgtatatgtgtcagaacccaggactgcctaagagtgtggatgcactagcaagctaattacaaacatttattttttaaatgtagtttcctatattttcctagagccaccaaagcacacagacagggattccatctaatatagtgattcctagtttactccctattctgtgaaaataaaaggcaaattctgatatatgcacaactttgttacataattcagttatttatcttgttttggtaacatgtttcattcagatatttgcacacatgttaaggcccattgcccaaacaaatcagaaaattaaaattatgggaagacatatttgagctgatgaataatagggaattgaaatatcgcatatggcagcacattgagaccatgctacttaactataaagattcatgtatcctttggtgtagtctgaataaattggtctaaaagtagagatgtttgcctgaaccattctcttctgagagaagatttcaagctttcctctctgaaggtgaattcacttgggcgaccccatacactccctctctgtgtcatggcttgctctcttcctttaacctcttcaacttttatccatacttgcatctcaagtgaatactactaaaagtgttttgtgatcctttgccttcttgatctcttgtttttattacatactttaggcacacaatctaattcatgcattattttctgggaaattattctgtaaacatcagatttctcttgcataccaaattataaacttgactgagagttgtatactaaaagtgatccttatctgatacatgtgtaggtttggttatttatttttattttttacttatctccatttttttttgtctaaagaatccaggtatgaccacagtatttacttgtgttctttcatagcacttgaaatggtgctaggatcagagcagcaatcaataaaagataataatatttccactgagagaaacaggagtaaaacatgagcaccaaaatccctccaggcttcatccatgacaagccattggagatggcatggcccagtggagaaatttatggcaaacacaaagtatttgctctgtgcagaaatgccctagtccctttctgctcaatggagatgtcaattatttacataaacatcatataacaacttattgacttcaagattgtaaagtaccctattaatgttttaagcatttccctttattttaacacaagtaaattatttaggcaatgttaaaatgttttatgctttgactaatgagtagagaaagtatatgtcatatcttattttaattggctgtttaccttatcctgtggaaattatccatttattatttcagacataatttactatgcatatactccctgacagatctatatgccatttttacacttgatctaatcattaagacacataactgtgcagataattgttacttggaaattgttactttttcttcagctatgtttccaccaagaggcaatgccaaatttttaaactgtctatttccttcatgtaattgacttggctctttgtagagaaggcttgtcataggtttctcaccaccttacattttcagatgacatgttttactagtataaagtagatcacaacaataataagttcatagatgaagttcataaactaatatctccccagtcaggctttgtcttccatagctgtgtggactctacaggaaagaaatgactccaaaagcaataccccatgtgtcatcctcataattcatctcaattccatcctatcaattaaagatattccctatgataaaacggactttgattcaaggcttccagctatttttaagagttgtattagtggcatataaaatgaaagctcattcacctcctccttctgtctttgtgtagcaactcatatttgtgcagttcataaaggtttatttagtaaatgtagtcctcacaacaccggtgtgaaatgggcagaacaagagtagctctattttccacaagattcagatcaaaactatgtcttctaatgcctgtataactttttggaagacaatacacagaaaaagaagtaatttcatctctaaagaaaaacattctgcaactcctactggcaactaatgaaagtcaagggtttccatttcaagggtcttcagactatagtttcttggtaatataaataattaaatcatgaattaaaacaactataatacatgtataaaaatatttttccttcttagatggaaaatgtctcctactgtgaagtacacaaaatctttagttattgtagttaaatctcaaatgcctaaaaaaggtcacataaaaagtaagagggttgggtgtaatacagtggaaggtgcatgcatttatagttatctagggcaaacaagtctcatttaagagttttcacaggtacactttttaaaaacactacacaatcatgttcctaggtatttacccaaatgagctgaaaacacatgttcacacaaaaacctggacatggatattcatagaagctttattcataattgccaaaacttgaaagcaaccaaaatgcccttcagtatatgaatagacaagtaaactgggacacgtagacaatggaatattattcagcactcaaaagaaatgagctatcaagccatgaataaacatggacaaactcaaatacatatttctgagtgaaagaagccaatgagaaaggctacacatcaatgattccaactagatgacactctggaaaatacaaaactatggagacagtaaaaagatcagtggttgccagagcttagggactaaggagggatgaacaggaggagagcacacgattttagggcagtgaaacgcctctgtatgatgctataattgttacagtggggagctagttggggatgagtaaggcaggaaagggctccccgacccacccacacacataccagaagtgttgggtgaccatggggtgatggtcagacggttgttaactgtctctctaaagtaataactgctcacagctggcaccagggaaaggcagtctcctaatagataaaaaacgcctgaaactggtgatcagcaacttcccaataagatctccagagttgggagaagtgacacaaaccacacaagtataccaacatgtaaaaccccaagtcaaaaggtcaaaccacacagttgtctttcaagttgcctgcttggcgatcttccacgtgtactttcctttctctgattcttgctctaaaactttttaataacctttctctcctgctctaaaacttgcctcggtctctccttctgccttatgcccctcgtaaaattctttcttcttaggagcaggaactgaggttgttgcagacccatatggatacaaatattttctaccactaacatgccgtgtgactcaggtaacttccactgttaacataatggtggatgcatgacattatatatttgttcagaccaacagaatgtatacgccatgagtgaattctaatgtatgctatggacgttgggtgataatgacatttctgtgtaggttcaataagtgcgacaagtgtatcattctggtgaggggtattaatagtcaggtaggctgtgggtggtcagggaaagatatatgggaaatctttgtaatttagctcaacttttctgtgaacttaaaactgctctataaataaaatttattcaaaattaaaataaaaaacacagtagtcaccaaagagaacctacaagctctctggtgattaacctctagctagaatctaagtgaaaaatggatttctgtcttacctcaggatagaagaatccacctttctcttctatttaatgggtataaaattatttgagaaatagcttatgaaatttaaaaaaaaaaacaacttatagcaggtaaagttatcatttgggagtaaaactgagtggcttttaagaactacaaaagatctcttttcagccttttgcctaagatcaagtgaagaactacaaaaggcttaaaattctttccaggtattttaggaatcactaaagtgcataaggacaagacttttatttttcaaaaggaagaacaaaaaaaaacatcaattgcttgtacctgcttagggagaataaatctctcagtgttaaattaaatctagctagtatcagaagtttttgcagatatttaaccttacaatttaaatgttcactgaaggacttcttgaaacattagaaggaagagacctctccttgccccaaagtccaatttctttgaaggttatatagagtttcacatttctatagaatgtgaaactcaattttgaaaaacaaaataactcaattttgaaaaacaaaatgaatattgaatcaagcgtaaatagtcaaaagtgagagaaagttaaaggtgtacatggtgtgatatctttgtatagcacagagggtgatataatggtatttgcattcaaacaaaaatgggctcaaactcagcctctcctccttgcttacatcgtaacactgggtaacttacccacccacgtggagcctccttagcctccaccagaacactgtgaacacaattattggaggaacctgcccccaatatttcaatgtaggttctttctattttctgtaagtgtttggctggtctgagaaatacagagaaagagtataaagagaggaattttacagctgggcctatgggggtgacatcacatattagtaggaccgtgatgccacctgagctgcaaaaacagcaggtttttattaattacttcaaaagcgggggggggtggggtgtatgaacaaggagtaggtcacaaagatcacatgcttcaaagggcaaaaaaggagaacaagatcacatgcttctgaggccaataaagatcacaaggcaaaggacaaagcaaagatcacaaggcaaagggtgaaatcaaaaactcctgataagggtctatgttcagctgtgcacctattgtcttgataaacatcttaaacaacagaaaacacagttcgaagggtctatgttcagctgtgcatgtattgtcttgataaacgtcttaaacaacagaaaacagagttcgagagcaaagaaccagtctgacctccaatttaccagggtggggtttcttccccaccctaataagcctgagggtaccgcaggagaccaggtcgtatttcagtccttatctcaaccgcataagacagacactcccagagtggtcatttatagatcccccccaggaatgcattccttccccagggtattaatattccttgctaggaaaagaattcagtgatatcttccctacttgcatgtccattgataggctctctgcaagaagaaaaatatggctctattctgcccgaacccacaggcagtcagaccttatggttgtcttcccctgttccctgaaaattgctgttattctgttctttttcaaggtgcactgatttcatattgttcaaacacacatgttttataatcaatttgtacaatagtgatcctgaggtgacgtacattctcagcttacaaagataacaggattaagagattaaagacaggcataagaaattataagagtattaatttggggaactgataaatgtccatgaaatcttcacaatttatgttcctctgccgtggctccagccagtccctccattcggagtccctgacttcccacgacacacaattctgcatgtaatacaataaatacagttggaatgaagattcaatgtgaaatgctgccctaagtgctgggcttatgcatgcatggctgataggtaatatggtagtgactacattgagtatgatgtgacaacccaaagtaaacttcattttgtttggaatattgaggcccagaggagagatatgttccacaagaaatggcaaactggatgctggcactggtggtgcattgcttcagaataatagaattgacattttcatttcctgaattaatatgaatccactgcagaagcatggtacctggaacatctagaaatgttggttgggtggcatgttactgaatggaattagtagatcctctccatgaagaaaagccactctttcttgccactgtagatccctgttcaattcctggcattttgtgaccgtctattccttcactcaggtggggctcatagaagtgatcatggtttatgttaactttcattgctgttaaaatttaatcctgtgatgatttcaattaaacatttattaattggaataccaaatcccattttattttttatttttaaaatttttattgctaagctttctcatcatttcctatttattttatccatttgaataggtgttaattttgtatatctccatttatattgatatagagtgaaagatataaggaagtaccctttaccttcagatgtctatgtgacgtttttattctttaaggaacaggtaggagcatatatcaattgcattttcaacaactgagattacaacaggtctttaccattgtatgtataaattggatgaattatattacattaattacctttaattttctaagctaacacatattaaaatatatgtatacacacataatggtgaatttgataggcaaaatagtattttattattaactgctttattggttagatttaaactgattttttaaaatattcagatggggccaggcgtggtggctcacacctgtaatcccagcactttgggaggccaaggtgggtgggaaacctggggtcaggaggttgagaccagcctgaccaatgtgatgaaactgtgtctcttctaaaaatacaaaaattagctatgcatgatggtgtgcacctgtaatcccagctactcaggagactgagataggaaaattgcttgaacctgggaggcggcagttgcagtgagccaagatcatgccactgcactctagcctggatgacagagcaagactccatctcaaaaaaaaaaaaaaaaaaaattcagatgggaattagctagctcccaagttagctccaaggcttgggagaaagaaacaaaggctttccatagcctcaaaaaaaaataaaagttttttttttttcagatggagaattagaggctttcagcattcctcagccacttggaaagagcaagacagtgcataaagatcaattctgtgagctttaattcaagaaggaaaatgggattacactggaacggtaaagaacataccagacccagaggggaggatgccagcaaagagcccctctgatggcacctggctgataaaagtgaatgaagccccagtacatgagagggaaacagagcttccctctgtgactcaccttaccactgcccatccaagcaacccagggctacggagagctctttgtttctcccaagccttggagctaacttggggcaaggcctggagacactgtgagagaaagacacctggaaaacctcaggcatttctccagacctgggacagagagcaggacaccatatttaatgtggtcacatacaaactcagccattttttggtgacttggcagcatggccatgcaggcattttcatcttgggccagagattgaagtgcccactctggaatgggtaggagcctccacagtcagaacttttgaaagtaccacagaagtaggggctggaattgtgctctcccccaccacaagcctagaccaggaggagaactgctaaagctgccattgttcctgagtggtgataaaccagggccagattggcgacctgaaaccagtcttaatgagccattgctgggttcgccagcctgcccccctgagatcatggtgcactgggtcactctccactccatctcctggcagaaatccaagcatttggagcacccatttgcctggatccacaccctaagttgcctcatccatcctttacagagatcctggtacagggaggccccctctcttcacacccaggcaggtctccaggcactcagggcacccactgatctggttcatcaacccaagccatcctacacttcctggacacggattgtgattaatcaaggccctcttcactccatgtccaggcagatctccagatgtctggagtaccagctctcctagatcagcagcatgaggaggcctgcccttcctgtgcacagatgctggtccaggaaagccctctctgctacatagccaggcatatctccaggcattcaaagtatctgcgtatatgcttcagtagcctaagtcacctcatccctcctgtgcagggattgtggcacagggcagttctctccactctatgcccagatggacctccaggcatttggagcacctattatcctagattagcagttgaggccactcctcaccccttcgcaaagagcctggagctgaggacgtttcccagctccatgtgtaggcacacttctggttgtctggtggccgttcactggattctccctcagtgcaggtgtttgtgcctgccactgggggacctttggggagccctgcccagtccagctctgctcatcatggcgcctgccacccaggagttgagtagggagtttaggccactgtgcatagaagtaattagcccattgcctgagcaacagagagcttctgacagtaaacaaggatcaagtatatacctaccctgctggacgcagccagctcttacctataaacaccatttatgggcttgtaggtcaaactgcaaagcccaatataaagccagccaaaagaagtgtatatggctatagaagcaaagccaaaaaccctattccatattctctacagtcatacccactggagagagggaggggcacagagagaaagagaaatttaaaaacactattatagggaaagaaagaaaatgaaataacacctcgccaatgtgaaaataattacaaaaattagaagtgccagcatctcctgatgggaaaaaagcaaacacaaaaatttataccataaacaatttgagtgtagtaacatcaccaaacgattaaactagctcttcagcaatggtctctagccaaaatggaaatgacatttaaagaatttgaagtatggattgcagggaagctcaacaagatgcaagacaaggttgaaaatcaacacaaagaaacttctaaaacaatccaggaaatggagaaacagataaatattttaaaatgaaatcaatcagagcttctaaaattaaaaaactcacttaaggaatttcaaaatataattgaaagccttatcaatacactggaccaagcagaaggaagaatttcagagtgtgaagaccttcttttgaactaactcaatcagacaaaaattttaaaaagaatttttaaaaataaagtctttgagtaatgtgggattatgtaaagcaaccaaacttacaaattattggtattcctgagaaacaggaggaaaagcaaaggtagtaattcaataaactttccctaatcttgctaaagacatccagatacaagaaatttagagaagacctgtaagatactatacaaaatgaacattaaaaggcatatagtcaccagactgtccaaggtcaatgctaaagaaaaaaccttaaaggtagctagagaaaaaggtcagatcatgtacaaagagaaccccacctggttaacagtggacttgtcagcagaaactttacaagctaagagagtttgaggacctattttcatcattcataaagaaaagacattccagccaagaattttgtattcctccaaactaagctttataagcgaaggagtgataaaaaattttccacacaagcaggcactaggggaattcattaccactagactatccttacaagagatcctcaagggagttctaaacatggaaatgaaagaacaatatctgctaccacaaaaacacacttaagtacatagttcacagacgccataaagcaaccgtgcaatccaaacaacaaagaaaccagctaactatttcatgatagtatcaaaagctcacaaatcaatattaactttgaatgtaaatagtctaaatgcctcacttaaaagacaagagtggcaagtgagatgaaaaaaccagacccatctgtctgctgtctttagagacccatctcacacatagcaatgcctatatgctcaaagcaaggggttgaagaaagatctaccatgcaaatagaaaacaaaaaggtgcagggattgctattattatttcagataaaacagactttaagccaacaacagtaaaaaaaaaaaaaatgacaaataagggcattacataattgtaaaggagttcaagtcaacaagaagacaagtattctaaatataaaatgcacccaacacaggagcacccagattcataaaacaagttcttctagacctatgacaagacttagatagccacataataatagtggggtatttcaacaccccactatcagcattagacagatcacaggggcagaaacctgacaaattcttgacttaaactcaacacttgaccaattggacctactagatatctacatccatcaaccacagagtatacattcttctcatctgcacagcaagcatattgcaagatcggccacatgcccagccatataacaagtctcaatgaatttaaaaaaaatagaaaaaatagaaatcataccaaacatttactcttgaaccatataaacacagaaatcagtaacaagaagatctctcaaaaccaaacagttacatggaaattaataattttctcctgaatgacttttgggtaaataatgacattaaggcagaaatcaaaaaattatttaaaataaatgaaaacagagacacaacataccaaaccctcttggatgtagcaaaagcactgttcagaggaaagttcatagcatgaaatgcctacctcaaaatcttagaaagatctcatattaacaatctaacatcacatctagaagaatttgaaaagcaagaataaaccaaccccaaagctagcagaagaaaagaaataactaaaatcagagtggaactgaatgaaattgagacccaaaatacatacaaagaatcaataaaaccaaaactttgtgctttgaaaggataaacaagatctatagagcactagctacattaaaaaagaaaaaaaatgagagaagatccaaataaatacaatcagaaataacaaaggtgacattacagcctatcccacagaaatacaagagattctcagaaactattatgaacacctctatgcacacaaactagaaaatctaaaggaaacaggcaatttcctggaaacacaccatcccccaagaatcaggaagaaacccttaatggaccaatattgagttccaaaattaaatcagtattaaaaaaaacaaccgaaaaagccccagaccagatggattcacaactaaattctaccacacattcagataagagctagtaccaattctactgaaactactccaaaaaattgaggagaaactctttcctaactcattgcctgaaacaatcatcacacttaaacaaaaacaggcaaaaaagacacaatgaaaaagaaaagtacaggccaatacccctaataaacatagatgcaaaaatcctccacaaaacactagcaaaccaaattcaatgcatatcaaaaaattaattcaccacaatcaagtaggcttctttcctaggatgcaattttggttcaatatatacaactaaataaatgtgatactccacataaaaagaactaaaagcaaaaatcatgtgatcatctcagtagaggtggaagaagcttctgataaaatcccaccatctcttcatgataaaaaccctcaacaatctaggcatgaaaggaacatacctcaaaataataagagctgtctatgacaaacccacagccaatatcatgctgaataggcaacaactagatgcatttcccctgaaaactgcaacaagacaaagatgcccactctcaccactcctattcaagtggtattcatcagagtaatcaggcaagagaaagaaataaaaatcacccaaataggaagagaagaagtcaaaatatctctcttcatggagggtatgactgtatacctagaaaatcctaaagattttgcctaaatttggcacctggaactgaaaaacaacttcagtaggatacaaaatcaatatacaaaaatcaatagcactcctgtacaccaataacgttcaagctgagaaccaaatcaagactgcaatgtcatttgtaattagccacaccaaaaaaaaaaaatgtctaggaatacatctaaccaaggagatgaaagatctccaaaaggagagttacaaatcactgctaaaagaaatcatagacaacacaaccaatggaaaaaacattccatactcatgaattgaaagaaataatattgttaaaatggccatactgcagcaacattctatatattcaaagctattcttatcaaactattgtcatggaactagaaaaaaactaatctaaaattcatatggaaccaaaaaaatagcccaaatagccaaagcaataccaagcaaaaagaacaaatccagaagcatcacataacccgacttcaaactatactataaggctatggtaaccaaaacagcatggtactactactggtactggtacaaaaacacatagaccaatggaacagaatagggaacctagaagtaaagccacacacctatagccatctgatctttgacaaacttgataaaaataagcaagggggaaagggctccctattgaataaatggtgcaagaaaagctggcaagccatatgtagaaaaagaaaactggacccctacttttcaccatatacaaaaatcaactcaagatagaccaaatatttaaatgtgagacctcaaggtataagaatcctaggagaaaacttaggaacaccattctggacattggccttgggaaggaatttatgactaagtcctcaaaagcaattgcaacaaaaacaaaaattgaccagtagcacttaactaaagagcttctgcacagcaaaataaactatcaacagagtaaacaaaaaacctacagaataggagaaaatatttataagctacgcatgcaacaaaggtctaacatccagaatctataaggaacttaaacaactcaacaagcaaataatcccatttaaaagatgggcaaagtacttgaacagatgcttctcagaagaagacgtgcaagctgccaacacacatatgaaaatatgcctcatgtcactagttatcagagaaatgcaaatcaaaaccacaataagataccatctcacaccaatgagaatgactattattaaaaagtcaataaacaacagatgctgatgaggctgcagagaaaagggaatgcttatacactatcgactggagtgtaaattagttcagccactgtggaatgcagtttggagattttgcaaagaagttccaacagaacttccattcaatccagcaaccctattactggtatgcatccaaaaaaataacaaatcatcctaccgaaacacatgcaccctcatgttcatcatagtactattcataatagcaaagacagtaaattaagctaggcacccatcaatggcgaataggataaagaaaatatggaacacatacaccatggattacaacacagccacaaaaagaatgaagtcatgtcctttgcaacaacatggatgccactggaggtcattatcctaagcaaattaatgcttaggaacaaaaaaccaaatattatttgttgtcacttataagtatgagctaaacattgggtactcatggacataaagatggcaacaatagaatctggtgtatacttagagtggggagggagagaggggaggaagcttggaataactattgggtactatgcccagtacctgggtgatggaatcattcataccccaaacctcagcatcacacaatatacccagataacaaacctgcacatgtatcccctgaatctacaataaatgttgaaaaaaataagaattcaatttttttcaaaactttattgccctaaaattatgttgtcaattagtttatgcgttttataatatttaactcttttcctaaatgtcatttattttacactagagtgtaaaatgaaaaattagatttggctcatttatttgtttcaattttgcaagcatcattagatgaatattttactctcattcactgttatttgatgctcctttatcacatactttatgtgtgcatgggtatgtctttgtgtgtctctgtgtgtatgcatcaagttacttttcaggttaccagttattatttctatgttcattctgtatatttattgctatgtcaatatactccctaaatttctgtggttttacaatatatttcctatttatgtatgtattttgatatcaaataaaaactcatttaattttaacttttaatattttccttgctaattctttctatttattttgtctctctgaatattaaaatcatggtgtcagataatcttcccaaatctcaatgtattcatacaattgaattaaactatatatttgagaatttatatttttaaaattataaaaaattataatatacagaaaagaagaaaagataaggtaatactcatttacccatcatctagattcaacaattattagcaatttagcatacatatttttaaatttttgtttataatgtatatttatatgtgtcctacacacatccatccatacatatatatacagtgtacatactataatatttatgtgtgtcctacacacatccatccatacatatatatacagtgtacatactataatatttatatgtgtcctacacacatccatccatacatatatatacagtgtacatactataatatttatgtgtcctacacacatccatccatacatatatatacagtgtacatactataatatttatatgtgtcctacacacatccatccacacatatatatacagtgtacatactataatatttatatgtgtcctacacacatccatacatacatatatatacagtgtacatactatatataccttttatatatttatatgtgtcctacacacatccatccatacatatatatacagtgtacatactataatatttatatgtgtcctacacacatccatccacacatatatatacaggtacatactataatatttatatgtgtcctacacacatccatacatacatatatatacagtgtacatactatatataccttttactcacacataccctaaaatatctaaatcatgacatttccctcttaaaaactgcggcatgtgtcccccaaaatgagaacactcccttatttgaccattattaggggcaatttcaataataataatgctacttatatcttgagttctttcagatttggaggtaaatgacagtatatgaaatatttcatgtatctctataaatactgatataaagagagagatataaataactgcattttgtgatcagatttctatgtgactttctttaatcccattgagaaatggtattgacatacatcggctgcattttccacatctgagcttattacttagttttgaatattgtttctacaattagatgcattatgtaaataacctttactttcctgagctaacacctatgctgtggtggtagatgatttctttattgttctagagacttagctactgatattttatatagacttttgcatccaaattcataacagaatggcccttggtatttgtcctcttcatgctacattgggcaaattttgagctcagcaattcatttaacttacaaaatatatatgttggctttatttcttatgtattttagattcatttgtggagtataagaattatattctttacattatctaaaaacctgcctggagatatcgagctgtccatctatctacctcaagatgtcaccaatagatagacatacacatatatatgtacatatacatatatgagatatatatgtgtgtgtatatttaaacatataacaaaacttgacatctttacatatgcatacacatgcatgcacaaagacctctcacagttccgtaatccggggcattttatgaataacaatgttttttcctgtttctgaggttgtctcttcagattttctacttcttccaaagttcattttgaccatatatgtctcctgtaatgtcaaatatcattttaaaatgagattaccttatgtcaacaagtattttcatatattcatttataattcacttttagctccttgtatgttctctttccctcttcatccctggtttatttagtcataagttcgtatatacagatacttcccaggtgtggatgcactctcaaaacacaaaacaaaatttttaaaaaaatgagacgttactggagaagatttttttatttttttaactaggaaaaacattaaaagcatattaagcgtaactgaatatccaataattccccatatctaggaaattatatactgtgtaacaattttgaacaaattatatattatgtgtcttagtgttttcaggctgccataacaaaatactattgtctgggtagcttattaagatcagaaatttgtttctgacagttatggaggctggaaaatccaagatcagggtgtcaggacagtttggttttagcaaggtcccccttccaggttgcagactgccgatttttcagtgatagaagtgatagaaggaacaaatgagctccttagagcctgttttacaaggaaactaatcacatttatgaaggctctcctctcatgacctaatcacctccaaaggccacacctcctaataacatcaccataggggctaggattttaatatatgaatttgggggcacacatttagaccacagcactatgtaatcaggatatatacatatggtgccccatttcctgccactgtatcttatattgaagataccacctaaacagatgcttactttctaaatacctcctatggatattggaggatattctagttttaatagcagattattttaagtattttcatagtgtttctgaaccataaaataaatgaatctgggattgtttagttttgttggtgaatgttaaaacaaatgacagagctttataataaatacctgggcagcaaaagcatatgaaaagaatgagacaaagtggggggtcaggaagtgggaggaggagctcataaagacacaagtgaaaagagactgtctttatgttctctcttttagttgcattcccagatcttatcacattttatggaccctgaaatcctaatgtgaggacatctgtttaacagccaatgaatcaaacaaatgattcccagggggctctaacagctcaaagtttgccttgcaatttgtatcaagtgattttaagtagattcgctatctaaacatgaactcccgtaagaaagcattgcttatgcctatggggggcgtttttgctgtcatgaccctaggaccaaatactgtcttaactacagagccaactggacacttttggacagctgtagaaagtagaacagttttgcaactaattttactgattagtctaaacttaaaccttaccatataataataatctctaagggctttctttagatcagtggtcagcaatttttttttttataaaggtccagataataaatattttcagctttgccagccctgtggtctctccccaaactactcaactttgctcctagcatgaacacaaccacaaacaatatgttaacaaatgaatgtgcctgtgttccaaaaaaactttattttaaaaagacaggcagtgggctgcatttgacccagagctatagtatacttccccccgccgcccacctccccacccccaccccgtttcaagcatagtctgggtggtttattcacaagcaaagtcaattataattggaataattgcagtaatatttaccaccacagaaaagaaaaggtgttttaacttgtcttactcagattccaaatctgtctttctcaacattccctctcccttacgtatgtaaagtcagacagcatggctccttaagaaggagaaggaggaagagaagtggcagcaactatgctctcttgcatttgattagaaataaagactccccaaattatgtgtttatggaccaatgtacctacttcattttatataaataaagcactggttcccccagaacgtctctaattctggggacagttcagcaatatttaaagactctttctaagatattttctagtaatttatatagcccaccagtatttgtatgttcttttgtcctaccaattgtttccataaaaattgcctaattatgtctgtcttaggaaagttctcacattgctaagaggtaaatatttgtacctttgcaacctgtaactgtactacaggcaatgggccctttcgaactaccttcaccttctattaccttaacctctttatccctataaacaaggactgtaggccattcccacagtaaataaattttagtgcaggcactaaaatcagactgcctagggttcaagtacaaactacatcacttacaaggtgtgaatagaagaccatccagcagcaacagtgaaggcacagaaaactactgtaagtctgttgcagtaactttggaaacagatgatagtggtttggaccatacctcgagtgctggtagaaattggtcataatacggctatgttaaaaaataaaacttaataggttttctcagtggattggatgcaaagtgtaagagaacaaaatgattgatgaatacactacagtttctggtcagaggaacaggtaaaatggaagtgacatgacctgagctggtgtaggttatgtaagggtaagtcttgagcattggggataaagaaagtaggtgttttattttagatatagttagtgaatatgacggttttatgtttcagcttgactacgatacagtccccagttagtcagttgaaaactaatccagttattcctgtgaaggcattttgctgatgtgattaaagttcaaaatcagttacattcaagtaacaaagattatcctacctaacctgggtgggcctcattcaatcagttggcggggcagagctgagaattccatgaagaaaaacaaattgcttcagcagacaatagctagagcccttgcctgagagttccagccttctctccgatctctgattttcctatccaggcctcccatcatgtaagtcaattccatgcaacaaaatttctgaaagacatctcttactgattttgcttctctggtttgatgctgactgatacatgattcagtgaagacttagatatctatcagtcttgagttggaagagaggtctaggctggagatagagatttgggactcatgagtgtatacaggttaattataggcttgagattggatgtgattatctgtataatgagtcgggagagaaaagaaagactgagaacagagctctggggcacactgcaacatggaactaaagaaatcgaaaagaaattgaaggagtcaggactacccagagatgtttgaaatgagctcaaataaagtagagttctggaagccaaatgaagaagttgagctacttgggaggctgaggcaggagaatcgcttgaacctgggaggtggaagttgtaatgagccgagatcacgccactgcactccagcccaggtgacagtgcgagacaccgcctcaaaaaaaaaaaaaaaaaaaagagagagaaaagaataaatgatgaagtgaaaaatgtatggatttgaccagatcaaaattagggattttttttctacgtgggacaccttggagaaaagtagtctggagaaacagagttcttaatatctaaaaccaacgtcaatgtggaatacacgaacgagtggctttaaatcacaccacgaacagcaaagatatcaaatttgaaagaaaaaagtattttaaaaagtaatttgctaaacaagatactgtatataaggagatattctatgtttctagtagtcaggaagaaacgaatattaaaacaaccatgaagtattattttatatctatcacattgataaaaattaggatgtgagatcattttaactgccagtgatgggcaaaaaaatgaaaacactcaggacccagctggtgagatataaagtggcacagactttctagagaacaatccatcagaaattaatgaaattaagtatgcattaatgtaatcccactcctggtgttattccccaacctcctaacttgccagcctgaagaaaaactcatgcataaattaatatggtggcaagtacaggatgtgctttgcagcactgttttacgcaagcagagaaatgaaaacaacctagatgccctgctaaggtgataaatacagtggattctttcagttggctataatgcaagagaaataatgaatgagagttatatacagcaaaatgaataaatcaaaaacaaaacatctaatggaaaaaataaagatgctagttcagtattctttatgtgaattcgcacaaggaaaatcatgtttttaagaaactacagatctcaggtcgtatattaaacactctctagtggctgtttctgtatggatagatagatggatagataaagacagtaattttaaaaaataatgagaagaaacaaatcttgcagagatgatgattatggtttctcatgaactgcagaatatctgagtttaaaaactgttttaaattttttctttaaagaacataccaacaatcaccattccaaatcttcactctaccattattcatgtgattagccaattgtgctctcattgaaaagaacctttagtttttcttccttattggtaaaagactcctctgttcagctagtaagaataacacacttctcagtaacctccatgctgatctctgtttactctctggtcattaaacaggagctttctctttctaattaaagctttccctgacagagttgccttcgagcaggtgtactgaagttcctttgaaatgatgaaatgggagaagcaagtgagtctttatattttcctttttaagttgccactgttctctcacagtattagatggcaatgcctaaacatctctgtattttgactaatttataatttcaagtaatagacaaaactactaagtgtaaaggcaaaactctaaagcaattccatgcaatctcaaaaaaatctagtgccaatttctctaggtaaattatggttcctttaccaccataatttataaatatttgatatttccaatgtgcaataaactaggcacatcatgtgaaacttggtataggaggaaatgtagttttaaaaaacactgacatactcagaaaactgtcatgtaacattcctttcccagtgacctctaaaagactttttctaaactcgtttgatttgtgttatctaaaatgttgcttccttcctctggccttctctcttagctttgtgactgtcaatgggggatttactttgaatgtccctacaagttgattgattaatacgacaatatagtctaggtcagaaactgccaccaaggctgatgtattgattgcactatcaactgaaatactgaaataacattatgtagaaaaacccagttagattttttttttaatctgaaaacatattaccgtgaaagcaacagaggtaggaaggagcatctcccttgacctagcaagccttatttaatacatgtcaaaataaatgatgcagtcaagaaaacatttaatatgatcaagcaatgcagccacctataggaagtttcacacagtgaggcatgggcagaaatgccttcaggcttacataaagatgggatcattattggatgtgccttcaaacaattaggctgataaaagttgaaaatccattttgagcatctgattttggccccctgattatcctgaaatgtgtccaaaaggcaagacccctcccccaagtgcatccagtacgcaaaacttcaagccaaagaatatataggcgtatatttttttgatacagggtctcactcccgttgcccaggctggaatacggtggcacaatctcagctcactgcagccttggtctcccagactcaagtgatctcacatcagtctctcaagtagctggtactacaggtgtaggacaccacttctgactaatattttgcatttttagtagagacgagatttcaccatgtagctgaggctggtctcaaactcctgggctcaaacaatgcacttacccaggcctcccaaagtgctgggatcacaagcttgagccaccatacatggcccaaagattatatcttgagacttaaggtttaatgttatttcccctgttaggttctgggacctgtccctcctttcttctttcctgtttctccatttatagtgggcatatctgtcctgggcctgtcccaccatttactttggaagcacataacatgtttgatttcagcagttcacagctggagaggaatttgccacagggtgaatcatcatacactgagtctcacccacatctgatttaaataatattaagatacaatttttgactttaggctttgaagtagatgatggaacaagagaagactttggggactgctgggatataatgtatatattttgcacttgaggacagaaattttggagagacaggtggaatgctgtaaacaaaatgtttatatctcctctaatttgattatgttgaaatcctacctttcagtgtgaggtatttgaaggtggagccttttgagaggtgattcgtttatgagggcagagccctcatggatgagattagtgccattataaaaaagacacacacccctcccacttttgccttgtaaggacacagccatctataaactggaaagcaggctcttaccatacaccaaatctgtaagcaactttatcttgaacttcccagcctccagaaccatgataaataaatgtctattaattataaattatgcagtccttggtagttttctatagcagtctgaacagacacaccccaatttcaaaatttcatagaaaccattaataatatgcaggaaacttaaaattccttcagggtcaagaatatctttaccagaaaagtatagagtatctacatctccccatctttcttctcaatttttataggaaacacagaaacaacaaactaacctagtaggatggttttttttctctactacttactttatttaaaatatgattttaactctactaatttcacaataatttaaaactcagaatcacaaagaggactcagctccataccacttagttcttgccttaacacattaacacttagagccaaagacatataatatctaggctagttttttttaatgtagtataaatatggaattctactgcacaaaggaagtatgaggcagaagccaaaatgtacgcagaagagcatagtagtgccgtgggcagggcagggagggtgtattagtccattttcacactgctgataaagacataccagagagtgggtatgtctttataaaatttataaaggttcacgctgctggtaaagacataccggagactggttgatttataaaggaaagaggtttaactaactcacagttccacatggctggggaggcctcacaatcatggtggaaggcaaggaggagcaagtcacatcttacatggcagcagacaagagagagaatgaaagccaagcaaaggggaaaccccttataaaaacatcacctcttgtgtgacttattcactaccataagaacagtatgggggaaaccacctccatgattcaattatctcccaccaggtctctcccacaacacatgggaattatgggagctacaatacaagatgagatttgggtgggagcacagccaaactgtatcagagggacagaatctggtctgtaagctgcttggcccattcactcttcctctgccctaactcctcccccaacaaatggaatctcaagatctttacaaaccatatttttcaagttgctggtttgaatttattagatatgaattaaatacctccaaaatactccttctatttcctaaaatgctaattcatatttgtttatcttaaaggatatagaataaagaatcttcatttagagggaacattaaaaacatatagtgcatgatattttattctatcaatcacccaacaatttttttaataggtctggagcttatacaaataaatgacagggaattttctggtaaggttttttcccatgacagagtcaccttgtttgtgtacaaaccagattcaagagactatcttgtatgttgcggttcttgtcacaaagggcatcttaatgccccctccagacctagtgcctgcagagaaggaggcagtctcttagtccccaaacagttggcttgttatctctcattccctaaaggggattatctgtatgtgtttgcttgaatatatattcccagaagtcttcatcactgtgttgaacacaagtttaatttcatgactacagattctgacttggggaaaaatattatttttagatatcagtattaaaaactatggtattatacgaggaggttgatatcactttactgtggatgccaaaataatttatcacaaatttggaggcataagacaatagaaaattgctgtgtcatgattcaggagaccagaagttctaagtcaaggtgctggcagaaccttgcattctctggtgcctctaagagagaatctgttctttgcctcttccaacttccaatggctgccccagccttctgactcatccagtctcttccttctgtgtcttctccttttatgtgtttcaattatccttttgcctttcttttataaagaaacatttttggatttagcactcacccagatagcccagaatgatctcctcatctcaagattcttaattacatctgcaagaccctttatccaaatcaggtaacattcacaggtatctaacattagggtatgaacatatgtgttttgggggcctctattcaacctactatagtctgcctctctctgtctctcaaaaaaatcacattcattctatctgcaaaacacattcaccctatcccatcatcctcaaaagcctcaacccattaaagcatctaccttaagtttaaaatctcatcaaaatatcatcagctagaaagtcccaaatctcattatctaaatcatccaaataatctatgagcgagactttgggtatggtccatacccaaagtatgtttggggtatgggtcaagattgggacaagttttctctccatctgtggacttaagaaactggaaaataaattatctccttaaaaaatacagttgtgggataggcatagaatagacatccccttcttaaacggagaaattcgaatgaataaagagatggtcagtctaagtttgaaatccagcaagataaattctattggatttcaaggccaataatatttctctgtggcttttctacgttctgggcccatgactctgccaccctctgtctctgctctgacagctttacactcagagtcattctttgtcttgaggagtatcacatgtttgtaaccaagtagctgtattagccaatttctggcctgtggtattccaaaaggccaacagcttttcttcatttcatcccctgtgctactgttccctccaggctggcaggtttctcctgatatcacattttcaaaagccatgtggttcttctatacatggcaagaggatccactccattagacaagagagttctccacagctcatttctaggtaacctcatttcaattcttggcttctgctgagatggatcagtgaagccatgaatttcattcctaatttcttcagcaaaacactgtccagccacacccttgggcactaattctagaacatgctttcgcaagagtaaattttctaattttaatatcgttttaatctggataggacaaaaacctctccaaacatcaagtgttgctttctttttgcttaatagtttttccctcaatttatctctttcctctcatattttactataagcggcaacaagaaagcaaggcacaaccttcaacattttgcttggaaatctccttgcctaaatatccacattcattactataaattctattttccataaaaaattaaatttaggcaagtaaattacaattcaaccaagttttccatcacactatacagacacaccttgtcttaaattgagggtttgtggcaaggatgggtcaaacaagtctatcagcactatttttccaaaagcacgtgctcactttgtgtcactgtgtcacgtgtcacattttcgtaattcttgcaacaatattcgaaacttctccttattttcatatgtgttatggtgatctgtgatcagtgatctttgattccaattcactgaaggctcaggtgatcattagcattttttagcaataagtttttattaagatacgtacattgtttttatcgacataatgctattgcataccttatagactatagtataaacataacttgtgtatgtactggaaaaccaaaaaattcatgtgacttgctttattgcgatattagctttaaattttgtggcagtcttgaaggaaatctgtcacatctctgaggtattacctgtaataaagattgcctttcctccagtttccaatcatgtgttcctcatttctttctcaatccttaccagcaaggtctttaatattcatatttctaccaacattgtgctcatgacaatatatgtattctctacgacaacagaaattttctctaccattcttctcacttccttcatagccctcaccagaatctcctttagcatctgtatttctgctaaccatctcttcaaggcaatctagtttttgtctatgttgcttccccaaattcttccattctttacccattcttcaattccaataccacctccacatttataggcatttagtacagttgcaccctacttcccaataccaagatctgctagtttcctaaggctgctattggtaataaattaccaccaacttggtagcttaaaaacaacagaaatttatggttgcatgattcaggaggccagaaatcctaaatcaaggtatcagtggacccacaattttctgggggatctaggagagaatccactctttacctctctcagctcccggtagttaccctggctctccacattcctccaatctctgcctccacaatcacgttgcctcctcttattctgcctgtgttatcctctcttctgtctatgtcaagtctccctctgtttccccttataaaggcacttatctttgagttaggacccacgtagataatccagaatgagttccttatctcaggattcttagtctaattacttacgttaatagtcacagattttgaggattaggatcaggacatattctttttggggacacctatggtaactattagaaaggtcaagttgtttattttttactctgaaataactggactttgaacatgtgaaattcctctggagtttgataatcatatgattaataaaggtattgatgagaaaaatagggaacgtgtgaaatatagacaccatatactagagttaaggttacttaaagttctggataaatcaaaacattatattaaatctgcccctagatttgaaatgttcattatgtgagataaaataaaagacctgaatcactgttgtatttacagaagccaaataatttctataaggaacatacatatttcaatgactgtgtgaatatgtgcgtgtggatgatggcacacgccatgctcattgtccaggatttgaaccagaacgcccagtaataactggagtatatgtggagtgggatatacctttaggacactgctgttacttactcctttcttttttctcagattgaatcaaggcctaattgaccttattcaaagtaaaagaatttgtgattgaatagtaattttcccattaatccttttatgattcaactaacttattataatcaggtcccatctctcatatgtaaaatttagaaaacttcaggagttaagaccagcctgaccaacatggtgaaactccatctctataagaagtttgatttaatcataattaagactcattatttgatgagtcagacttgatgccttccacagagttgtgcttatttgtcctctcttggggtgctctaggtctatgctcactgctattgaacacataaaatatgtttattggccacttggtgtatttagggcattcttgaaatgatggtcaaagatgcttattggaagactctgaaattcaaagatgtggaaaagacataaagtgttagtgatacaggagctgaaaagaaattatgtaggcagatagtgacggtaagagagtcctcggtaaggtttcccttttaataaaaagcagcccccaaatcatttttttctaacaaagaacaccctgaaaaatcaagatgcagacatagaaaagcaagctagaagcttgcacgggtgaatgccagcagctgtgccaataggaaaagatgacctgggggccaggtgtgttcaacatggaggctccatctttccttttcttcatcaccaggtgtacagtaaggaacacacaacaggtagataacccatctgcttaataaaagcttaagatggggcgaccagcttctctgcacgctatgcaaaatggcacaactggtctgaccaatctctcgtcccctgtgtaaatcagacactgcctctccaagctcatctataaacccccatccatttcaccacagaaccagaagacccacttgggagcccctctctttctgcaagagagagagctttttcttttcctttcgcctattaaacctctgctcttaacctcattccttgtgtgcccaagtccttgatttccttgccaacgaacctcaggtattatctagatgaacgacaatgcttcattagagccaaactcaagaattaatatcctaaaaaggatattcagaaaaagtcagtatggagaattcaaggagagcttcatatctttgaattcaataacatgaatatttaaatttatgtaattatgtgtgtattattccacattgcattaagagatccttcagtccactgatcctcagagatatgagatggtcttattgggttagtaattcactatagttatatagactctgaatatatagacagagttctccaaaatagaaaagtaaatacatgtcaatataatgagtcttcaaaagtaatccaaatgatacagtaaatgtaaatgaatgaaaccacatttatatcacagagcttcatactaaccgattttcataaatttaccaaagtgctcaaactaattacataactagaggaaaaatgtatatttactgttgtataacctaaaatgtgtgtagccctgttgagtctgagtacaaagaataatgtttcctcctccaattaatattatgaaatacaaaaaaatgcattcattttctctgattgacagccccaattttggatatatattctaactaatggaatattgcaatacatgactcaattacagttgttcagttgtctattttgtaaagtgagaacagtttgaattatatatgattttattgtgtatgtgtcatggtatctcaactgacaacactaccattggtaaatttggctctaatgagaaacttatctacatgcatataaccctatccaattgctcatttcctatctattgttatttgtggaagaaatggaaatgccttcatacttgcatttgacacaagagtacatttaaaattgaatacggtctcaaaccaatggcatataggccacatctatgcagtactaaagaaacaaataatccctctatccctaaactccatccctaaaataatctttctccaccccaaaaaatgatttaaaaagggaaaaaaaacaaaacaaggctggtttctgatttcatataaccaataaggtgctccccaaatatttcattttagccttgtccaaatttgtggacaataccatattttatatgacagttttcagcaaactaaagtgagttgacagatttcagttcttccatgtgtctaattgttcatgccaattgatatgaattaggtaagaccaaagataaatactacacaaatgctactggccagctttcagttaatgaaatagcaatataaaggcaggcttggacttaattatttatctaaagagtctcaaaatgtttcactgcctaacattttcctatagttggggtagcaagcactatagagaagagaacaaaagagtattgagatgctcgttgaagactagattgtttttgtagtaatgggtgttgtctcactacttagttgtatgagtgtatgcaacttaacctcttggggctcagtttcctcatacctaaaatgaagaggccaaatacgatgatcaccagcattcttgaagctctaacattacctggatatattgatcagtctttctgctaccttattaaagctgactcttcaattcttgtgtcattctagcaacttcttagagactttaggaacataaattctaagctaatatttttccaggcacaataatcaatatcatgaattgatatttacatagcattttgaaactagtaaaaatcaagtaagttccattaataaagattggttcaggtttacacagatatagattgaaagggatgttattccaagattctgtgacctagtgctatttctactagaccacactgcttcttcctccatgaaagaaaacaagcaccaagcactacctgaatattctttatttttgcatttttttcaaacttgaggttaaattagaaaaatattattcctcttgtttggggcaagaggttgagctacaatggcattttaaaaaatgaaataagatattttggacttaaatataatggtttatatttagttttctagcaggcaatcacaaaatcccttcaaagattgttcagaaatccattcgtgtatgcatgcaatttgctgctgtgcataggcaaattgatttttctatattcacagtgatgcatagtttgtcattttatgagtaagctgcattgctgaattgatataatcaataatcacaaagattcattggctaccttttgttttcataatgcagtatctgcaatgaataacttgacagatcataactagtgaaaatatttgccatttatacgaaaaaccatatgttattctgaaaattactattcattgttaaatattccgacttaaaaaacatggtggttcaacagtcagaaaaatattacacagatcacagctatttaaagatgtctacaagaacatgccattttggtgtatttcagaaacccaaatgcatggaaaaacctctgaccaatgttatttttcagcatctctatcctctctagcaatcatccaacatgaattcatatagacaaatggaatgcttttgagagttaaacatgatagaaattacttacaaaagtcttatttcatatggagaaggaactttaaatttgaccaaaacatgtgttaatttagccacatttaagttgtttttgaagtgagttttatttacttctcctaagtcattaaataaagtgaaattgtaatgaaagggtttttacaattctttaaaatgatttcatatattcctttcatcatttttagtttatccctgttagtgcaacttagtatcaaatataaaatgaaaaatagctttattttatattgactatattatttatgacatgaaaatagtatctgcttgcaattaaaattcattcatattatgcaaaaccatttattaattcattcagttttattcattctttcattgattcatttatttgttcaattatctaataagtatttataagcatcaactatgtgtcagattttatcctaaacagaaaggtaggagtgaacaaaagtcaaaatccttattcttatggaatttacaatctagtggaagaagacagaaaataaacaagagtatcatgaggtaataaactttgtcaatataactaaagcagaataagagcagagggagtgatatagtggggttgtgctatttttcatagcgaggcaaaagagggcatttctgataagatgatacttgaaaagagacccagatgaaatgagagcacaggctataacaaaactgcatttttttggtataatgctgctaatcctctaatcagcttaatatattctctaaattacactcagtaattagtaaaaattaatttttgttgatcaataggatgaatgaattgattcactattatgagattctgtaagttggaaaatgaggttgggtccttacatatatttcacctccttgattcgttaacatttttaaaatatatagttatttcagattaaaaatataatgaaacagtaaaaatgtcattttgcatcataattaattgaatattgttaaatgaatgaatggatatgagttaattactagataccagagttggaagggcctataaggaattatgtaagaatcatacaaactcttcagtaacagtgatcattcaattttttttttctttttttgagacagagtctcgctctgtcacccaggctggagtgcagtggtgtaatctcagctcattgcaagctctgcctcccaggttcaagcaattctcctgtctcagcctctcaagtagctgggactacagacatgggccaccatacccagctatttttgtgtttttagtagagacggggtttcaccatgttggccaggcgggtctcaaactcttgacctcaagcgatctgcccatctcagcctcccaaagtgttgggattacaggcgtgagctgcttcacctggcctcagtgcttttttaaaaaaaatttattttaattgtccaggaaccatgaatttatatcataaaataatctacttagtttttcaacagcttcattaaatagaatattatccctttaattgaactgatatttagttctcttaaaagtagagagaacgtctaccctttggatttatacaaatataactctggtgagctaggtaaggaatgctcacccttaggttagtgacattcctaaagctgataatatatgctacctgctgtcattactattcctggactctctggcaagcagtatgggatacttgagaagtaggtcgttcaccaaattaagctgcagctcttatttgcctctggttcatattccattataattctcagtaggtcaattccaactatcctcattatgtgtcaaataccttttgatgccaataacatcaaggctaaaatgatggtaggtcaacccagttcatgacagtacacttgaaaaggacattttccatctttttttcctgctttcttgatctcaatcctgaaaggtctaataccatattgctcattcataaacataatgtctctttcactcaccttacaacaagtaagcagatgctttgcaatgatgaaccttgattttgctttgaaaagcaatgtagttatgctttatttttacctcatacaagtgaggaactgatgcatatggtaagattttctataacactaagtccatggcccataaaatgtgattttaaatgtcaaaaacttttttataaatagcatttttaaatggagtccataaataagatctttctttcttcaagtataatgattttactacgatgttcctgttgagcacacttttgatacaactatgcctatggactcctatactgtttatccagttctgctgtcttgttctattgtgagatacttggaaagatagtgaattcctcatccctggaggcattttttaatacttggtgaaatcacagtagaagaagctcaagcactggatgcaggattgaacccaatgacatttaatttcactgataacccaagatggtaacatactctgctgtcactatatcataatatctgttgagagggaaggggtaagggtttctagactttatgtagactgtgtggcaatcctttgccctctcagagaccttttaacatttcaaacctattttacttgtttccctagctttgtttcattaggttgagactgtctgtatcattgagaccagctctcatctgcaggtaaacaaactgagggtctctcagggcttcattctactctgccagcatgagttcattatcataatgtttttcattcatgttggacacatttcataggagttagatccattgatttcactggaaaataatcattcatattattgattttgtagctcacaggttctgaccattatccttgggaaaatatacagcattgatagttacctgtcaaccaaagaacatggaggttttactctatcaaatactgactaactcatcttaaaataattgccaatattagcactccttcaggtagaaactcttagaaactaatttgaaagaaaaatgagtaatgggatctttttgcgtaaataaaaattgctctgtgtgttgccatctcagtgaaatgtagcaatttacagctttgtttttaagaaagatcacagaaagcaatgagcaagaaattgtttccaaaaatggtcagttagcattgttcccactttgattttccatggtaatgagtaacataacttttaatcaaagatttgctagccagtcatattgacaaacacatcctgagttcaattcttcaaaacagaatataggctgctctatatgcaaacgagggagagaaggcaatatgaacaagatcaaaatacaaaaagaaagagagataaccaaattctgcaataaaggtgatgaatttatggtataaatctctttgatttgagggcctattgagcaggaagcaggattctgtgggaaaacaagacgggtagtgtatgcattatatgctttagaatgtggtgagaaaaaactacatagggacattagcctattcagccatccctgccacctctggtcccctgagaattctaactgcctttgccaagtgatttagactttcaataatgtctctccatgaacaatgggaaaatgcaacacagtggtcagctcgtttctggcaaaccaatgtaaaactgttaatgacacagtacaccaatgacaaggctttgataattacataaagccgaggtctcctgttacactttgactgaagaactgcaaaaataaagccactatgaaaatgaccaaataaaacatgttgaaaatgaggcaggcgacttctctcgtagacgacattaaaaagcatgaagagaagttactgggatcaattgaccatagattgtcctagtgttgggccctgatagacagctttgatgttgaatgggaagaagggaaaggaatatgggtggtatgaccaggtcaagagcatagacaaaatcattccccattttagggcaaactgtttagagatgaggggagaagaaagaatgaaaacagttgaacaaataactctccagaaatttcttcctcttttcagaattctggtattgctttctcttcttaaccatattagtctcctatacccatgtatctactcatttcagtacatagtctggcctaaaagagaagtttgcattggctttcagctatgggagtttggtttatacacattgttcatacagagagtatgaaacgagagaaatataggatgaagaaatatgagagtatgcacaataataaacataataacacattgcggtgtcactgaaggtatagggttaacaggtgcagagagacagaataacgtttacccaaagtgcacctgctatggagtctcactaccctaacttgaatactggattcatcattatatgtaagtttgattggtaacaagttctttatgttctttgagcctcaaccttcttgtctgtaaaatggtgataacaatcatgttttgcaaagattaaacgagatatgtaaagctttcttaaagtgcttgtactttttaggctctccatcaatggtaactgccattagtagtagtggcagtagtagtaatagtagcagcagcagtagcagcagttgaaggaggaggaaaaggtagaaacattttcttgcaggatgtagtaagctactttcatgttgcatttgtaggatccagaattaaaagtggaacaacccagccaaaaatacataggaagatgacaaattacaaggttgagcttaagggctgccaaattgccttgcctctaggaaacgacagcaacataaaagactatatcctgcagcagccagtagactgggaaagccagaaccatcagtgccttctgccacaggccagccaatccaccaggtaccagaagcatgttcctctgcaaccactgtgtcataaataacaggaacaaggagtataattttgatgtcagattggaccacaaacacacataatgtatacaaattaaaaatgttaatttaatactgttatctgtcatccaacaaaatgaatccagcaaaaatgctggattgtttctatataatccaatggttgatttttcaaatactattactctcttttctatcactaacagaggaatttattttgctgattttttttagacttcacagtctttgatattttctttttttctttaacaaatgttcataccacttttgatgtcctctgccacattgcatgtacagaatttttgttttacttctgcaatgagctaaaaatatactcatcagcaaaatatacgtagctttaacttcatgtatctgttttatcctgaggaatacaaaaattgttgaaaataaataagatgctttcatactaaggtgaaatttatctgtttccttttcaaagaaatacgtgtgacatccatcttttggagaaaagtaaagcagaaaggtaagataaaatggcccttgctggcttatttattcacggaacgtatggggatggagtcacataaactagcaccttaacagtctgtattgttgcataagaggcaaacttagaatccaaggtagtaggagaaaaagtaagaggatggggatagattttaacctgtccttgaaaaataagttctctatctcaagagtgacgcatttatctccatttaaaaggcgaagggtgagtctgagtatgtgaccttgggagacatgctgaataatttttaatgtccacagtatatggcatatcaacaataatagcttcatttgaattaccaagaaaaaaatagcagctgaatccatatatcaaagaatgactcattctggattttcttactatattttccattaaacaccctcagcttcatgtaatcaaactctctccatcacatggggatgcttttttaggacactttcccgaaaaatagatacctcctctctgaacctccagttttggggaaataattatgttgtattttgtatagctcatgtatttctttgtttgttttcttttcttttttctttttttttgtttttgtttttgagacagagtctcattcttgtcacccaggctgaagtgcaatggcgcaatttcggctcactgccacctcagcctcccgggttcaagcaatttgcttggctcaacctcccaagtagctgggattacaggcacccatcaccatgccctgctaatttttgtattttcaatagagacgggatttcaccatgttggccaggctggtgttgaacccctgacctcaggtgatccacccaccttggcctcccaaagtgctaggattactggcatcagccgccttgcccagccagctcatgtttttaataggctgtttgttttagtttccataaacttagtgggttaaaacaacataaatttattatcctctagttctggcagtcagagtatgcactggagttcactggactaaaataaagatgttggctgagctgcatttttttctggagattttggaggaaaatctattttctttgctttcccagcttctagaggccattctcattttttggttcgtgatcctgttccatggtcagggcctgcaatggctgttcaagtctatctcacatcacataactctcacactgattgttccctttattcttccacatttaaggacccttgggattccactgggcccatctggataatgcaggataattgccccatcttgaggtcagctaattagcaactttaattccatctgctacgtaaattcccagccgtgtaatacagcacagtcacaggtgatagggactgaggtgtggacaaccttgagaaaccattattctgtctgctgcactattccagatgttaagcccagtgtttctctcagttaaacttcacccaatactgcttattattctccctggaaccacatggaagaggtgtaattcatcttccacaaggcactctggaataggtaaagacatctcccatgtttccttagcctccaagtatatcaggtattttaatcactttgtggatcatgcagttttgcatcttttctctgtccagaaataaataactacaacaaaaacaatacgtaaaatttattgagcaatgtgctagattgagtaaatgtagacatacagttactcatttgcaagattttcacattgaactatcacaaaaccacaatggattttgtgctcctattgtctgcattgtataaatgcaagccctgtgagattcagagggtcaatgtcactcacccaagattacaaagacagaagaaatcagaggtgcaacttgagctcaggtctgccttactatagaagttgctcatttaaccatatgctatactaagggatatatcctattttgacagtgcttctctaaaattatagttcctagcactcaatgtcatgtctcagacattttctctgcaatgtatgaaacaattttgtcctagaaataggtcaacgaaccactgaattttgaacagcagaaacatagaaatagagacttggtctgctcaaaaacagttctgctaggagaaatgatattatacttctctataaaaccaagggttcatggagtgggcaaggagaaaaaatatatatatctctaaacagttcagcatttacattaactatgttgaagcataattatcctttttaacaacaatcttatgcaaattatttcagtcacaacatttttaatgctgaatttggctaacatatacaagcctatatacagaactttatcaaagagtcaaattcaaaataaatattagatcttaaaatgttactagcataattaatttttgccaaaactcacctgcacttagaagcaattcatcttaactagctctactcagtttcttaagagcagaaataaaacatgtgggtattttttttaataactcttactccctagtaagacaaaacacatttgttttattcttatgcctgaaatatctcgtgtagattcttaagattgtaacaaacctggaaattaggagggagatttgccttctgatcctctttccttagcagaaagagaattgtgggaaatatttttgccaataatttattttctttgatgtataaaaaaaaatggaggcagtaagggggtggtcctaaccctcagtatatataatttggctctaggcatgtagaaatcaaaagggagcataaatgtggtctctgacatcgaagctctatatcatgaaaggacacaaatttaaagccagtgatgatataattcagtgaaagaagcacacagcttccaaaaatcagttcaagtctttcctcttgtaacatttgaataaatactctgcatttcattcagtggtttatttaaacatagttattgagtacctgctgtgtgccaggtactatgctaggtataccgaggatttaaatgaattgttttttagggatacaatttttctctcattatgaaaagcacagtctagtaagttgaagaaaacaagtaaaatatatcttattacatagtagatggtattaagtgttaagaaaaaaacaaaaaacaggaaatacgggaaggaagtatagattgaaggaatcagtttttgaaagggtgacctggaaaagccttcctgaaaagaaagcatttgagcaaagacctaaaggagctgaggggttataccatgtgaataactggggagaaagaatagtaagtagaaatgccactgagtgggtgtgtgcctgaggtcttcaaagaaaagcaagaagacaagtgtggctggaacaaagaatgagatctgaaaggaagcggttaggttgatgggttggatcacgtaagactttgtagatatttgcaaggactttggcttttagcctatgtaagataaaattcactggaatattttgattagggaatgaactttatgacttatatattaacaatatcaccatagctgaatgggagaacagggtgggatcaggggctgccataatctagggaagaaaccatgatggcataaatcaagctgacagtggtggaagtggtgagagtttttgacttaagtgtagatttaaggttagagcccatgtgattttttttatgcatttggagatgaagcatgagataaaataaatggtgaaggatgacttcaagaattggggtttcaggccaggcgcggtggctcacgcctgtaatcccagcactttgggaggccaaggcgggcggatcatgagatcaggagattgagaccatcctggccaacatggtgaaacctgatctctactaaaaatacaaaaattagtcaggcatggtggcatgtgtctgtaatctcagctactcaggaggctgaggcaggagaatcacttgaacccaggaggtggaggttgcagcgagccgagatcatgccactgcactccagcctaggtgacagagcaagactctgtctccaaaaaaaaaaaaaaaaaaaaaaaaaaaaaacagaattggggttgcagaaactgagaggatttactatatgtctatgtgtctatgtaaatgaggaaggcaataggtggcacagatgttggatgggacaagcatgagctcaactttgggagacgttaattttgagatgcccattacacatctaagttgacatatcaagtaggcattgagatatatgagtcacaagttcaagggaaagggtccagacttaagatacacatttggcattgtcactttctgtaaagagttggtattaaaagccatgcagtagggtatcttcctgccgaagtgtgttatttagctccaaggctctgtttttgatgttgaggaggaaccagcaacgaaggcagaggagaatcagccaaagaattaggaggaagtaaaggatgtttcacatacagggtagtgtaatcaactgtctcaaatgctaaactgacataaaaacattccatgggatttatccatgcgacatgcattggtgaacaggacaagaagcattttgattaagtggtgggagcaaaggtcaattgcaatgggtttaagagagaatggataggcaggaatggaagcaatttttttttgtcaaaagtttccttaaaaagagggagtaaagaaatgaggcagccacggaggggtaaaagaagggccagatggttttctttataagtttactttttaaaaagaagttatctttaaagtctgtagcaataaaagcatatgtgtcctcaaataaaaaaatgacatttgaagatataggagagaatggtaagattttctgtcaacataacttaagtaagcaagagggtttagaaactaatgtcaagtggattagccttggctaggagcagggacagctcatccactataaaaggaaaggaagcataatatatagacaccgctgttggtaaagttgcagatgtggagtggagactgtggaagttccctctgatggtttttattttctcattgttaaagaacaaggtaattagatggaggttgaagatggaggatgaggtgacaaaaggtaaatgagagagggtagaaattatgatacaaaagagtgtaagcatggatggagtcaggaaatgtgctataattatcagtcttgaagactcatttaaggttaataatcatgaacttaaagtgataagatttaggatggttctgtgttttctggttatgttcagctgtaagatgtaagtgggagtaaatggcagattggatttattatgtgtggtaaagtgggaaaagccaagaaagttgaggatgcatgtaatagaatgttataaaaattcaccatgggttttattccaagtaataggctctcagtgtgggtctaattttcattgcagtggtcatttggtaatgtctggagacatccttggttgtcacaaccgggtgggcgtggtactgatatttaatgggtagcttttggggatactgcttaaacatcttataacacacaagtcagtccctacaacaaagaaatgctcagtccacatgtaagtgttgcaaggatgagaaaccttgagcaaagaaaaaggaaatgaggatatcaggagaaggacaaatgaagtagatcctggtgagacagaagaactgctggacttgggttagtaaaacgagtaaactgcaagtagaatagttttgtagccaaagaatagaatacttgaaattgagtttatatagaaaatgtacatattggtgatgacaatatcaccaagtgactaaagtagggtggaagacaatatgattaaaatagagaacaacaaggaaataagaagcaagggtagaggagggaccacttttgtggatattgacttcatggagaataataacagagaaagcgtgggagacattgacggtgagtcagcggtgaaatcttgaggaaataaggaaataacccaggaacttccagatgactgacaagggtggttgaattagaaggtaacatattaaaagctggaaagtttagagagaaaaattacatggaagtagcagtgaagaacaagaagatcatcaattctacttttatttttgtagagatgaagtcttgctttattggccaagctgttcgcaaatcctgtctttaagcgatcctccccactcggcaaccacacttttaagcttaagaataatgggtgcagaaagaatgtagccactattatcataaggcttcaggggaaaagggattctggggaatgggggactaggaagtttgagtaaaggagtgaaaagcaaacattatgaaagacaatatagaggattttactaacgattgattgtaaggtttcagaagttaggaaaataaagatagggtcaaaagtggaatgtgcaacgcagtgtggagaggaaaggacatgaaggatgatttgggagtgctggatttctttttgtgacttatataataaagaggggaaaattgtagatagttacacttatttcaaagcagaaaatgggggaggggtcaaaatgggaaagtgtaagaaatttgccaagatttgcagagttctgagctccctcttgacctcttgataagagatgtggagtcttatccctgccagttcacatgctgttgacacagcaccatattagaaactgtcgattttctggattaggaaataatttactccagtaacccttgctctttgagctgaaagaaatttgtgaattttaatggctgggatttcaacaatagagtggcttagttattctgaaagatatttcttcttcaaaaacattaaatccttaataaaagagtctctttaatcatttctgggttcacaatatgtaagaacggtatgctgaaaccaaagtgaaaaattgtgagcagcaagcaaatagcaagcttgagatggaaacaaggaaaatggtaatatcaagagtgcaaactatcgggagaacaaaactcagacaagcatcaaggtgaaggtgaaagtgaaacggctatggaagttcaggagataattaaggtattcgattaacattttaattaagaagcatggtaaagattgtgatggtaactactaaaataatacacccgtctgggacgctgggcccatggtcacaaggcctcagccttggggcctcgccctgctctaggccaagcgcggtggctcacgcctgtaatccagcactttgggaggctgagatgggcagatcacaaggtcaggagattgagaccatcctggctaacacggtgaaactccatctctgctaaaaatacaaaaaaatagccgggtgtggtggcacacgcctgtagtcccagctacttgggaggctgaggcaggagaatcgcttgaacccgggaggcagaggttgcattgagccaagattgcaccactgcactccagtctgggtaacagagtgagactccatctcaaaaaaaaaaaaaaaaaaaatagacatacaaaatgtaatttctaaaactttaggggtagggaggaaaacggaaaaataaaacaagcaaacagtaacttaataaatcaaaaccaatgaatatctaatggggtatattccccatgtcttttattttctgtaatttgatgctttgacatctgaggcttttctacccctgaagggactgccccttccagtgttagccaatccccagagacagtaaataattcacccatgaatgtgctcttcaaatgcaaaccaaccagtctagaatctaaaacccaaccacctcctttattgggcttccacattatgggtcaccatccacctgccataatcacccaaggatcagacaattagctagagcccctaagcccactgaaattattcagaatagccagtcttaaactcaattaacctgcctcacctgttccttcttatggacaccacattaaaggctcttgccaacaattttccctctctgcctcttcaccaatcctagtacatccctgcttggcctctcatggcacagcacagcccttcctcttgggatctgagtaacaaactatcttttcaatagcagtcatctctcctgatctcttgggtaaaccatacataagtaatggtaagacctacattttaaaacaaaaggaaataataaaaataaaaaagcaaaaaaaatcagactctagaaacaaatccagatacattcacaatcataataaatgaataaatcttctagttaaaagaagacaaattggataaaagaaaagtaaatctagctatgtgctctttgcaaaagtagatcaaaagtataagggtcagccaggtgtggtggtgcatgcctgtaatcccagctactcgggaggctgaggcaggaggagcccttgaacccggcaggtggaggctgcagtgagccaagatcgtgccactgcactccagcctgggcaagagaacaagagtccgtcttaaaaaaaaaaaaagtataaaggtatggagcagttaatggtaaaagaatgaaggaaaaaaaatacatatatatatacacatatacatatacacacaccaggcaggcaagtattatccaaaagaaaactcaggtatgtatcaatataagactaaaagttaagagagaaattttacaggattatagaaagttaatagttaactagaaaaacaactaaacatctatgcccctagtaagatagcttcaaaatataaaaagacttaataaatgttttatatatatatatatatatatatatacatacatataaatacacacacatatacacaaacacacagatatatgtctgtatatataatttttttggaatatgcctgtaaagcccagataataattgttattgtcagaggatactgtatactacctcactacttccaagtgtagttcacagagcaggaacattagcatcacctatgagcttgctagaactatagatttcacacttgccctagatttcctgaatcagattatatgcacataaatacttgggaagcaattatctgtcacatgctattttttaaaattatttttcttcctctgagtaactggttttttttcactttatttttacctgtaaaatcttatgtaagacttctgattttccctcccacatgtaaggagtttggaagttatcacttcaccctaacaaataaaaagctgaactaactaaaactcaacaactctttttacatcaagcagagaactgtgatctctgaggaggatctctggaagggcaaaccactgcctctccccatagctggaggagcagacaggcagactcaggtactcacaacttatcagagtggagacccatgaacaaaaacttttgcaagagctagtaacatgacaggaaaatctgaactgcaactgacaaactgctggaggttcagtgtggatacaaaattgttatctaatatatacaagaagtcttaaaacttagccataagaaaaagaacaatgctgctgtagtctgagtgcttgtgtggcccccactcccatccccctaaatacgtatgttgaaaaactaatcaccaatgtgataataggaggtgaaatcttcggggggtgattaagtcatgtgggcagagactacatgactagattggtaccctcaaaaaagagaccacagagagctacccagtctcgtccacaatgtgaaacagtgagaagctgcaggccaggaagtgggccctcaccaaacaccaaatctgctatacccttaatgttgaacttcccaaccttaaaaatggtgagaaataaatttctgtcgtttataagtcacccagtctacggtattttgttacagcagcccaaatggacaaacctcactttaaaacaggcaaaagacccagacaacttactaaagaaaatacatagatagcaaagaagcatctaaaaagatactcaacattatatgtcatcagagaattgcaaattaaaacaacaatgaaataacactacacagctattagaatggccaaaatccaaaacactgacaacactaactgctggtaaggatatggagcaacagcaattctcattcattgctggtgaaaatgcaaaaaggtactgccactttgaaggtagtttggcagtttcttacagaaataaacatactcttactatataatccagtaatggcactccttggtatttacccaaatgagatgaaaacttacattcacacacaagcctacacatgaatgtttacaggaggtgtatacagaattgacaaaacttggaagcaaccaagatgtcctttggtaggtgagtggaaaaataaacttggtatatccagacaagggaatatcatacagtgctaaaaaataaataaactatcaagctatgaaaagacatggagaaaccgtggatgcatattgctaagtaatggaagttaatgtaaaaaggctacatactatatgattccaactgtatgccagtctggaaaagacaaaactatgaagatagtaaaaaggtcagctgctgccaggagttagagggaagcaggaatgaatatggaagaacacagagtatttttagtgaagtgaaaatacactgtttgaaactataatggtggatacatgtcaaaagccatagattttttttaactcatagattttataacactgagagtgaaaacttaatgtgaactatggactttgggtgagaatgatgtgtcaatgtaggttcattgattgtaacaaatgaaccaaccactccagtgtaggatgatgatatggaagaggctgtgtgtgggagggaggggacagacagtacatgggaacaccttatacttctcatgcaatcttgctgtgaacttaaaactcctctaaaaaataaagtctatttaaaaagtcttgtataagatttaatcaactattatcttttaaaatgtatttataaataagtcagttaggatgtatcagtgttaattgttcaaataacaaaactaagaaataggaaaataaaagagccatgtatctattggttttggcatctgagcaagaaaaatattttaacaataaagacagttaacttatatgtaagtctcatgtttgcagttgataaaggtgatttcactttaaccttacttcattaacactatatatgagctacaaagataatcgaatgttgtttgtttatttcaaggtaaagaaactgaggctcagtgacttgcccaaaatgcaaagataataaatagaagaattgaaaaatctttacaatatgttcattacctttttactatacaagatagcagatagaagacaagctcaaaagcctaagattgcaattattcctagggtgcttttgacagtaagggatgatttgtataaaataattttttaaaaaaatgtttaacttaactttatatttactagtgggaatatttagttaccaacggtaacaggtaatgtaaaatgattatttggatgttcttggtaggaaaataataatcacattataaaatcagggctgaatttaattttgaagtcttaaaatggaagttaaatggtagcacaaagagcattcaacattgagctaagagcttacaaattcacagtctgattcattaattcacagcctggcattcatcatatgcctcagtttccactctgtaaaatgacaagattgagagtaaatgatcccaaggtttccctctagctctaaaaattctctattctgcacacatatggcactatattttaaagcacatacgcctcctgtgaagtgaaataaagtgaataagcacacggaaatggtacggtgattaaatttactcagagctaaaaatcattgcatattagccttacatatgaaaaaaaaacttgactaatgaatcaaacttgaaggatctgtcagtgtgcagttgtttgacacagaacaaggactgtgaaattgctgattttatcccagtgattcttgtatgggtcacacacagcaaaaagaggggtcagtaagtttcacattcatatatataagcttgtaaaaggaaagaaaaaggagtttcttttgacattgcaatgaactatatgagtcttaatgaacattactgttaaggcacccaagcaaattagcgtttccccacatgccttagcttgcaagaaattaaatttggcctaaataaattaaagcagtggacctgacacatctgatcatttctacctctcaattatttttcctttggtcaggttttcttggaagaaattattcattttgaaatgttgatattctggttggatctatctctgtgctgtatttttgcagctggagaagctatggactgtggatttcaagtgtgacactcactaagaaacccaaggagtcaagaacactattgcattcgtggggataatttcagaatcaggtttatccggaacctggatattcataccactactaagaagtgttgcaattcttttaggtatgatgagaaggcttttaattataatggaatccagtagtcagtggaaaactaaaggcatttgcggaagctgtccaaagataatacaccacaaagtaatgatatgtaacaataatcagattaaaattaaaagtaaaatcatatatataaatgaaatattaattatgccctgcatgatacttagcaaaaccaatgtcaatgtttatgattacggtgaacatttgtcaacactctacagaaacttcccagccaaatgagtgaacatatgcaaaataaaatggcataaaccagcatttctcaatcttggcactattgacactttgggccagatactgttttgtgcgatgctggatgttcagcagcatccctggcccctagccattacatgaaaatagcaccactacctctaagtcgtgaaaaccaaaactatctacagacattggcaaatgtcttgaagagggcaaaatcgcccctaggtgggaaccactggcatgaacaaggattccagagaactgaggtaatcacccctaagaggaagcttcctgcatcatatgtgtcaattaggcaatgagatgtggctaatctgacactggggctgccactaacactaatgactaaggaagcgtatattgaaatatgctggtttatttgtttctgttgctccttgtcctgagctccaacattataaatgagagtggtggttttatttattttgaacttgcctttgttgtgacaccatccattaaaatgcacagtaaaaagccttagaatttcagacccgtaactctcacttgcatacctagccgattggcgcaatatataatacagagcggttcattgcacgcttaaggaagcgtaacctatataggagggggatgaggggcatgccacattgttactgtaaggataaatagtataaatctttcctcaccagattcctccaacaggatgaataaaggtacagataagaaacaaagggatagctgtcaattattggattttgtgagtctttggcaatgtattaaactctgtcgtacatttactaaacataatctccctccactcaagaactaaacattagagggcagagattttcatgaatacatacttgaggcagagaaggaaaacaaagggaagggatagcttatcaatatgaaggatggagaagtgctgtagtaaggtacctgggaataagtgctgtgtctagatttgcttcacattttgataaaataattcaggttctcacataataactgatctaaaagaaatcatgtaaaatggaatatgcaagtttacagacgatattaaattcttctggatagtaacaagcgaatgaggataggctgtggaaagaactcgcaaggatataagggagagtttagaaacaacatatacgcctctgttactgcagttgttaagtggtacgtttaaagaaaaattgaaatgattcttatgaaataatactaagctatccattttcactatggagatgagctaatgtgatttttaaaatttgaaattattgggccaatgatttccaaagacagaaaatatcaagaaggatatttttaaatggaataaaatacagataataacaacaataccaaaaaaaaaaattctcttaacctccaacagaattatgttaaatctaaacctgtaagattttgttcctatgattgtctcttgtaaaaggcataatgaaatttataatatttttgcaataagcaataaatatgatcaagaaatttaagaatatttacatatgaatagactgcaaatgagaattctttccatctgcatggaaggatttattcaccatttataaagtcatagaaaatatgataaaaatagatatgaatttttcaataaggcctagaataaaagaacttgcagatactcattatagcttggaagaggtaacagaggaaaacaataccagatctgacattatacctaacatattgtgcaggctggaaaatgccctaattcaatgtacatcaaacacacatttattctttcattcatttattagactgttagccatggtcacattgaattttatattagagagaatattatgccttcctgcaaagtaaatatgaaatatttataagaaacaaatgagataatagatgtgatacatggctaaactgtaaaatgcaatgcaaatatgagctaaattgtgattgcttatgggtcagaacttgactttgactatggtagattattcaatgaccacaaattattctctaccctccctacatccacaccctttaggaggcacccctacactgactctgagcttggccttgtgacttgctttaacccatggatcgatagcaaatagagacttggaaagcactttgcattgaggcttgccttcttttgttctgcttggaattcttccactaccatgttaagaagcctgggctagcctgctgaaaaaagacatgtggctcctctcctcatcataccagccacaaccaacaatggtaaaacatgtgagtgagaacatgtgaaatcttccaaacctaataagtgatcatagacacatttgcagatccagtagacatcagtcaaggaaaccaaaatcagaatgttccaatttgcccaaagaatcatggagctgaatagatgatttttgcaagctagtaagttttgttttgttttacagtaaaagttgttttataaacttcctgctacctggaagtgaggtgtctttaaagacaattcaaagcttttgaattttatcttgtggagaagaattacagcttccttaatattttatttctttttaatttttataggtacatagtagatccatatatttatggggtacatgaaatattttgatacagccatgcaatctgtaataatcacatcagagtaaatagggtatccatcacctcaagcattcgcccttcgtgtttcaaacaattcaattatacttttaattgtttttgaatgtacaatgaaattatttttttactataatcaccctgttgtgctagcacatactacgtcttatccattctatctttttgtacccattaaccttcctccacttccctcccccaccccctgccacctttactacccttcccagcctctgataaccattcttctactctctatcttcatgaattcaattgttttaatttttagcccccaaagataagtgagaaatgcaatgtttatctttctgtgcctgccttattgcacttaatgatctccaattccaagcatgctgttgcaaataacaggatctcattctctttatggctgaatagtactacattgtgtatatgtaccacattttatttatccatttgtctgttgatggattcttaggttgtttgcagatcttggcaattgtgaatagtgctgcaataaacataggagcacaggtatctcttcaatatactgatattcttcctttttttttttttttttttttcagacagagtctcgctgtcaccccaggctgcagggcagtggtgcaatctcggctcactgcaagctccgccccccgggttcccgccattctcctgcctcagcctcccgagtagctgggactacaggcgccgccaccacgcccggctaattttttgtatttttagtagagacggggtttcaccgtgttagccaggatggtctcgatctcctgatctcgtgatccgcccgcctcggcctcccaaagtgctgggattacaggagtgagccaccacgcccagtgatattctttctttggagtatatacctaggagtggaacgggattgctgaatcacatggtagttctatttttagttttttgaggaccctccgaactgttctccatagtggttgcactaatttacatttccatcaagagtttactagaattctcttctctccattatttgtgatcacctgccttttggataaaagccatttaaactggggtgaaatatctcattgcagttttggtttgcatttctctaatgaccaattttgagtagtttttatataccagtttgccatttgtatgtcttttttgagaaatgtctattcagatattttgtccatttttaaaattggattattagatctttttttcctttcgagttgtttgagatctttatatgttgtggttattaatcccttgtcagaagggtagtttgcaaatattttctctaattgtgtgggttttctattcactttgttaattgcttcttttgctgtacagaagatttttaacttaacgtgatctcatttgtctatttttacttcagtttcttgtacctgtggggtattactcaagaagtctttgcccactccaatgtcctggagagtttctccagtgttttctcgtggtagttttatagtttcaggtcttagatttcaatttttaatctatcttgattagatttttgtatatggcaagagataggggtctagtttcattcttctgcttatgtatatccagttttcccatcaccatttattgaagaaactgtcctttccccaatgtatgttcttggaatcttggtcaaaactgagttcactgtagatgtatggatttagttctgggttctgtattctattccattgatctatgtgtctgtttttatgctagtactatgccattttctttactatagttctgcaatataatttgaagtaatgggattcctccagttttcttcattttgcttagcataactttgtctattctgggtctttcatggttttaaataaatttcagagttgttttttctgtttctgtgaagaatgtcattggcattttgaaatgaattgcagattaagtctgatctgtttctttgttgtttttctgtctagaagatcagtccagtgctgaaagtggggtgttgaaatctccagccattactgtgttagggtctattgctctctttagctctaataatatttgctttatacatctgagtattgcagtgttgggtgggaccatatatatttaaaattgttaaattctcttgctcgactgacccctttgtcattatataatgacctttgtctcttcttacagtttttgtctcgaaattgattttgcctgatgtaagtatagctacttctccacttttttggttcctattggcatgggatatctttttccatctctttattttcagtttatgtgtgtctttataagtgaagtgtgtttcttgtagccaacagatcattgggtctctttttgtaatctgttcagccattctatgtcttttgattagagagtttaatccatttacattaaatgttattattgctaaataaggacttattcctgccattttgttatttgttttgttttttgttttttgtttttatggtcttgtctttcttccttctttttttccgtctttctcctaatgaagctaattttctctggtgatatgatttagtttcttacttttgattttgttggcatccattgtatggttgttgatttgaggttaccatgaggcttgcaaatactatcttataacgcattgtttaaagttgataacaacttaacataatttacataaaaaacaagcaagcaaaaataaaactaaccaaaactctacaccttaacttcatcccccaactttttaaatttttgttgtttctatttatatcttattataccctgtcttgaaaagttgttttagttatcacttttgattggttcatcatttagtctttctattgaagagtagtttaaacaccacagttataatgctctaatattctgtgttcttatgtatgcttactactaccagtgagtttagggccttcagataattacttattgctcatgaacgttcttttttttttctgattgtagtaatccctttagcatttcttgtaggacagatttggttttgatgaaatcctgcagctttttttgtttgggaaagcctttatttctccttcatgtttgaagaatatttctgccaggtatactattctaggggaaacattttttttttctttcagcactttaactatatcatgccactgtcttctggcctataagtttgcactgaaaagtttgctgccagacatattggagctccattgtatgatgtttcttttctcttgctgcatttaggatcttttctttatccttgccctttgggagtttgattattaaatgccttgaggtaatcttcattgggttaaatctgcttggtgttctataacctccttgttcttggatattaatatctttaccttggtttgggaagttctctgttattattactttgaataaactttctacccctctttctccgtttcctccttaaggccaataacttacatttgcctttttgagtctattttctagaccctgtaggtatgcttcattgctttttattcttttttcttttgtctctttggatatgtattttcaaatagcccgtcttcaaactcactattttttttttctgctggaccaattttgctcttaaaagactctggtacattcttcagtatgtcaattgcatctttcagctccagaatttatgcttgattcttcttaattacttcaatttctttgttaaatttatctgacagaattcagaattccttccctgtgttatcttcaatttcttggagttttctcaacaaaggtattttgaatcctctgtctgaaaggtcacatatctctgtttctccaggattggtctctggtgccttatttaatacatttgatgaggtcatgttttactggacgatcttgatactcgtggatgttcacctgtgtctaggcattgacaacataggtatctattgtagttttcacagtctaggcttgtttgtacccttccttcttgggaaggctttccagatattctaaaggacttggatgttgtgatctaagctgtatgtgcattagggggcaccccaggccaataatgccatggttcttacagactagaggtaccaccttgatggtcacgtacaagatctgggagaattctctgtattacctacctagcagagactcttgttctctttccttcctttctcccaaacagagtctctctgagctgcctggagctgggaacagagtgacgcaagcacacctgtgaccaccactaggactgcactgagtcagacctgaagacagcacagcactgggtttcacccaaggcttgttgtaaccactccctggctactgcctatgtctgctgaaagccctggggctctataatcatcaagtgacaaagccagccacttctgtcttcctttccggtcagcaagtttccccaggccctgggcaggtccagaggtaccatccatccaggagccaaagactacactcaaaaactttagaaatttacctggtgttccattgtaccagggctaagctggcactcaaacctcaaaatgcagtctttcccctttctaaaggcagaggaacttcaacccatggccactgccatcacaggtccacaggctactgccaggctaccaccaatgttcccttaagggccaggggctcctcagtcagcttgtggtgaatgctgcatggcctgggactcacccttcagagaaatgggctccgctctggcctaggacaggtccagaaatgcctttcaagagccaaagcctagaatcagagacccaagagcctcttggtgctctaccaccctgtggccaacctggtacgtaagatgaaagaaaaagtctcctttacatttccctccacttttctcaagcagaaggagtctctccccatagtcaccacagctgggaatgtgctgagtctcacctgaagacagcaagtctcagagtccccccaaggcccacagcacactacctgggtatcactattggtttttcagggcccaaggtctcttcagttatccagtgatcaaatcggccaggactgagtccttcccttcaaggcagcaggttctcttctgcttcagggtatgtctagaaatattgtccatgagttagggccttgaaagtgggcttcatgactctaaccagtaccctgtcctgctatggctgagctgatatctgagatgcaaaacaaagtcctcctcactcttccctctcctgttctcaagtagaaagaatgggtctcttttagtaccatgagctgtgtgccaggggaggtgtggcaccaagcactcccctagacatcccagctggtagatggggatctcagtagattatataccccccaagtcccctggctctgagcccaggtcagcactaagactcacctaggaatggcagtcgttgtggcccacactgtcatttaagcttatttagagccccatagcactttagcctgcagtggcaggacttgcaagaactcaagttccaactgctaggatgggtgattcccctctggctagggatgacttaaataccccctccatgggcaggcatcagctgagttcattccagttttgctttctattataacagggcagcactaaattcaatacaatgtctcacaattacttccctctctctccctgaagcactcaaattctctctctgcaccaaatatcactgctgagaggtgagagaggggtggcatcagtgattcaagactgtttttcctacctcttcagtgcctcttttcagtaatatgtagttaaaacaatgtactgtgagtgcacacctgatttttggttcttatgaagatgcttttatgcgtgtagatagttattaaattggtgttcttgcagggggggacgatcggtggagtcttttattctgccatcttgttatgcctcctcccaagttacaccttctaaaaaacaacctccaacagggctttgtgagaaactaagatgataagacatgaaagtgtattgaaaattgtaaaaattaattctagggacaaaataacatagacttaattttctctgttcctcccctctaaatacatctaaatactctgaaaataatttaacagccaatcataaaaagactctgacatgtggaaaggatacattaaactataaaagatgctcgagacttgaggagtaacaccacagtgaatttcctggattttttttctttatatctcatatatcttagactgtggaccagagagggctgcaatctggaactgccaaaagacatagaaaaagaaaagaaaagaaatgaaaacaaaagaaaagaaaatgaaagaggaaaggaagaaagaaagagaaagaaagaagcaaagcttgctctctctgggaaaaggactatgaaaggaaaagcctaactttccttccatggaggcaccagcagagatagaatatgacagccactggcactaggtacgtggagaataggtcaagggagatgctctccaatcgtccccctcacaatggcccatggaagaaccctccatcctcaaagcaaaccagcaaatatttagtgggcattcaaacagagccagaagagccaagccaaccagattagcactgcaaggaattcaaaaactaagttcttactgggatataacccagaaaagtaggtcacaacctatatgctgaactgtcgagtccagctcagtcagggaggccctaacccagcagcactaaaggaattaaagacacacacacagaaatatagaggtgtaaagtgggaaatcaggggtctcacagccttcagagctgagagccctgaacagagatttacccacatatttattaacagcaaaccagtcattagcattgtttctatagatattaaattaactaaaagtatcccttaaaggaaacgaagggatgggccaaattaattgcagcaggaacacgcccttaagacacagattgctcatgcttttgtttgtggcttaagaatgcctttaagcagttttccaccctgggtgggccaggagttccttgccctcattcccataaatccacaaccttccagcttgggcgttatggccattatggacatgttacattgctgcagagattttatttatggccagttttggggccagtttatggccagattttggggggcttgctcccaacactgaacctaaacagaaacctcctattaaaataaaatatttaaataggatcaaaatgtcctaacttaatatttaaaatatccaagatacagtaaaaaaatcactcagtataccaacaaccaagaaaagtgaagcctgaatgagaaaagactatgagctgatggcaatactgagatgaatcaaatgttgaaagaatctgatgaacactttaaagaaatgattttcaactagtaattaaaatttcccgagagaaatgaaaaaaaagataaaacatcagcaaaaactaggaattacaaaaaaagaaccaaacaggaatgtaaaactaaaaaatacactaaccaaaacagaaaactcattagataggctcaatagcaaagtgaagttaaaagaagatagaatcaagaaatttgaggacagaacaatggaattcactaaatctgaataacaaagagaaaacagaaacacataatttcccaccacaattaccatccccaaaatgaacagtgcctcagaaaactggcacaataagaaaagagatattattggagtttcagaaagagaggacaaagaatttggggctggaaaggtattcaaagaaataatggctgaaacttcccaaatttgtggaataaataagattacagagtcaaaacctgagcaaacacaaatagggtaaacacaaaggaatccacaccaaaacaccttataattgaacttctgaaaaataaagaaaaaaatatttaaatccaccaggaacagaaaaaatcaaatgaacagatttctcatctgaaactatagaggctagaaggaattagcataacattttcatgtgctgaaagaattgtcatatgtaaattctatatctggaaaaaatagctttcagaaataaatgaaaaataaaggcattttcagatgaaggaaaactaaggaatttgttgcaaatagacatacctttaaagaatatctaaaagaaactctccaaacaggaaggaaatcatagcagaaggaggcaaagaacttcagaaaggaaagaataatggagtggtaaaatcaggggcaaatataatacactactgttctcttgatgagtctcctaaatcatatttgatgatagaaataaaaattaaaataacatctgttgtgtcactcaatgtatgcagagaaaatacttgaaacaactctctttttcaagtttggaatttaaagggacctaaagggcagtttgatgctccacttgaagtggttaaaggatgataccagagattgtcataactcacatttgtctattgttatactcaggaaattatagaaaactatataaagcaatacactcaaataaatcaagatcaaagcctaaaaactgctcaaaaatgcacttgaacgaaatatatgataaacagaagaaagagaaacagaagaaatagacagaaaacaaatcataaaatgtcagtaatgcaaatttaatgcaaatgtgcttttagaatgcaattgtttatgaaacagaacctgaaatgtgggcaactgctttaggaacatatcaatgtcttaatttgcattttgcttcaattttgctctatgatttaaatgatttttggtgacttacaagtgttgtttattatggtaagaacattcccttatttagacatgagtgagagctttttgatggaaaatgtcataacaaaatttaatttatttccaaatatatagaaacaaatgatggctttcaggtttcagggttcttatagatggatataggactacatacttcagttattttagtcttaatcccatgaagaagtacaatgatgcagaagaaaatgtgataaaacagttaattgagattaaaacaatgggatttttatttttacccaatgaattagcaaacacttaaaacgctgataataccagtgtctacgtgagttggggaaacattactctcttccactgttagtacagttatcccataggggaatttattagtatctattaaaatttcaaacatgcaggtcctataacccaacatatctactgctcacctatcctagaataacaagtgtttacagtgttcacatatgtacatcgaagatttataaaaacaaacattttgagacaacctaaatgttcatgaataggatggtgactaaatattgatatatctgaactacaggataatatataataggttttaaaaatgatgaagacctataaacactaatatggaaaggtatcggagtgaataaaacaaattgcaagacaaaatatagttaagatactatttatatttttaaaacacaaaaaaattatatatttctttatagatatatgtagatagttttatagaaagaggtctgtcatgatacatcccaaactgagatgcttagtaactctagggatggataaagaaaccaagattaaagatggcagccaaagatagattttttttttttgccttattgctaataatttaatttatgctagaagattacactaatatatagtttgtatattttaaaaatgtgttcaggtacaaaacacatggtttttaaatgtattcaaataatacaaattttaaagagctgcaaacaatctttaaaatctcaaatatgagttgcctgtataaatctgactttgagtatttttaaattcctctctttgttttcaggacacaaacttcttgacagcagactactaggacactgctggcagggactaggtcattttcaggaaggccctgctatgcctgtaggggttgccataggcacagttcatgaggctaacctagaaaagtgttattaggaaacaatacatctttgccgaaggatttgtttggaaggagagaagacagaaaatagtgcactgagtcaaaggttagaagagcaggtaaactgaaagttaagaatgaactgcatagtattccatggtgtatatgtgccacattttcttaatccagtctatcattattggacatttaggttggttccaagtctttgctattgtgaataatgccacaataaacatacatgtgcatgtgtctttatagcagcatgatttataatcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtttcgatttgcatttctctgatggccagtggtgatgagcattttttcatgtgttttttggctgcataaatgtcttcttttgagatgtgtctgttcatatccttcgtccactttttgatggagttgtttgtttttttcttgtcaattattttgagttcattgtagattctggatattagccctttgtcagatgagtaggttgcgaaaattttctcccattttataggttgcctgttcactctgatggtagtttcttttgctgtgcagaagctctttagtttaattagatcccatttgtcaattttgtcttttgttgccattgcttttggtgttttagacatggaatactatgcagccataaaaaatgatgagttcaggtcctttgtagggacatggatgaaattggaaaacatcattctcagtaaactatcacaagaacaaaaaaccaaacactgcatattctcactcataggtgggaattgaacaatgagaacacatagacacaggaaggggaacatcacactctggggactgttgtggggtggggggcggggggagggatagcattgggagatatacctaatgctagatgacgagttagtgggtgcagtgcaccagcatggcacatgtatacatatgtaactaacctgcacaatgtgtacatgtaccctaaaacttaaagtataataaaaaaataaataaataaataaaaaagaaaagaatgaactgaaagtgacaggttgccagagaggtggaaccacatggaatagagcagagaaagaaggagataaagatacagactacagcctattcagagtgacttacaaatgcaccgttctggataggatgccgtggggcagcctctcagcacacatatcagctaggctaattatatgttaattgtagttatttatcctggttttataatataatttctctggaagttgttagaatttttattctaactttaatgttctgaaatttcatatacatatggaataaattgctttggatttttatttgttttattttccatttgatttaatttggttttgtaaatcctgctcaacactgagtagggtcttttttctaatctcctaactttatttctctataaaggaatattctctgttatctcttaaaatattggcagctccgtattacgactaatcttttgaaactctatttagatgatttttgggaacttctgggtctgttctccaattctcttcccttttattatttctctgtctttagtttcagctttataattaattctactgccacatacattttgcactttggcctataaatttcacaatttgtgtttttttatttttatagttctagttggttcttctttatatccacctagtcatgttatggaataaaataccatggctccaaagacaaaaaagactgtctcttttattctttgcgtaacttaccagctccaactgtggcctgaacttctgctatttatcattgagaagtgagaagatatagaattagccccactgactgaacactagtttcctgtaatgctcttcattgctctccggcattcattaccagataaccaaggcatgtcccggagtatctaatgtaaactcacatattcactattcatcctggggcgaggtccatagatttctgctgcctgtccaaagaagcataggttgaactatcaaattgcttcaatgatccagggaattaattgctcttaaacctcctcctacttttctatactgcagaaatatcacatctaaagtaacaatatttcttgatcttttgtgctgcaattatcctcttcagcttctacttcctaatgactgctcagtttctatttaccaataattgctcataattgccataattctcttgcttttttaattttttaattttttatttttttgagacaaagtcttactctgtcgcccaagctgtagtgtagtggcgcgatctcagttcactgcaacttccacctcccgggttcaagcgattctactgcctcaacctcctgagtagctgggactacaggcatgcaccaccatgcctggctaatttttttttaatgtatttttagtagagacggggtttcactatgttggccaggctggtcttgaacagctgatctcgtgatccgccccctcagcctcccaaagtgctgggattacaggcgtgagccaccatgcccagccgccttttttttgtttgttttttgttttaaagagtgtgacttttagggatcgagtacgatggagctgccaggtgtggttattttgccaccttgaaacgagaatgtatcatcttatctctattgattgccagagttcaagaactagagcaacaggggtctcagcttttagcagcgatggcttttctagggaatttatttaaagcacttaaaatgatgcagtgtagtatgcacaaaaatttcaaataattataacttttgactcagcaaatccacttctgggaatttgaccaatattgttaatgataccattcagttaagatgtttagttaaggacatttattgcaatattatttaaaatagcaaagtattagaagccatctggatgttctttaaaatggttaaatgcattttggtctatttttactataaaatattatgcaactattataaagaatgaagaaaacatgtgcattgtcttctaggtctgacaaaaatgtatcgttcggtaaaaatatcaagttattgagtaagttcagttataactgccccacaacctgcagcaagcagcccaggtaaccaactcgttatttagctatagacagtgaggctgctagctctttcagacttaaagaagtcaaactgcaatttctagttagtagttactagtccagaaagttaacaataagcgctgcaacaataggctcaaagcagccacgagttgactaataattaacaattatcctcgtttttgtcctcactgccaaattaggactactcagagaaagccaaatatgcagccctaattaatcatatagaataccctgcttctcattagtttgcctacagtttgcgcatgccaacagcctccgataaaggcacactggaaaccctccttttattcttcttccattataaagcttgcccacacctctgaaagcttgcccactcctctgcctggcttggagtttgccaaaacataaaggattgtggctgacacccttgccatcacaagttctgaataaatagtatttccttattctaatttggttggtcttcatttatttcccgttctgtaaagaacaatattgtttgtaaaaacaaatagtatgtacacaattgcatatgtttaaataaacaacataaaaaggccacacgtgattttgttaagaatgtatgcattagggatatgggacagcatgtattttattatttaaatgactaaaataaaaaagataacatgatacattcatctacgtattcatatagtttatttcacatagcaactaattctaataatcttaatactacagattttttttttttttttgagacagagtctccttctgttgcccaggctggagtgcagtggcctgatctcagctcaccacaacccccacctcccaggttcaatcaattgtcctgcctcaacctcccaagtagctgagacaacaggcgtgtgccaccacgctcagctaatttttgtagttttagtagagagggggggttcactatgctagccaggctgatctcgaactgacctcatgatctgcctgccttggcctcccaaagtgctgggattacagccaccacgcccagccaatactacagatatttataaagatatttgttatattgggtgctccatgtggctattttaggagtcatccaacaatggctcttctatgtgaatgccagttcaaaactaagagtccttaataggactaggaaataatttatttttgaactaaaaatatttagcttactgagaaaaaaaattaaatgccttcctgctgttcttttcaatattcgctgtgtgttttattctccagttagacttagacacactctaaaatatattctagttttatcttaagtattgctatatccaaaggaacaaataatgtttcttatcatccccttcctgctggacttcataatgcatttgattcccagctattaaccctggagacctgtgttcacagtcactttgtgcttaagaccttataggtttagtcatgtatagacattcttacaaagattattactttttttgtactgaacaatgtttgccaatattcccatgacttgcagctaaaagatgactagaagatcaaccagtcaaaccactggagatttcaactattctctggaaatactctttgcttatgggcgggggaaaccaccttgggaatatgaacttttaacagtatcttgtagtcttttcttgggagaaaaaaaagacctatagtttagtcgaccactgagccttaaatcacttcaaagtatttttcgatagcttttgataaaagggtgttgttataacaaattacagtcaattaaaatagacagtttttggtgaattactcagggaaactcgtaagttcagcactttgccaaatcatttgctagctacatgggtaacaaaaaatgcttagtgttgagataataaaatatgagaaaattgtttcattttcactcaaaactgtatttttttttcctcttgggagtcttttaaactaagaattataacttctatagatgaaataaaaccagttctataaggggttgtgaaccatcttatctcaaaggtatacttaaggttttctaatcattttaggtagagaaactatcaataatatataaataaatttttgatggataagtagaactccacattctacttatccctatagagatacaaggttttaactcctcctacaagaatctggaaaactcactcagccacagaattctggtactatttaaccagaattttagtattaaaattattttattaaaaagaaaaactgtgatgaaaagatccatatcaaatcccaccataactctttgcagtgactttgttggatcccaaccaccagaaacaagtattttacgttcacattttcttcttcctttccttttctttcttcccttttctttctttcttatttttaggacagactgtttggattggcttccatttatgaggatgggaggaatagaaaaagttcctgtctgtaatgaaggtgttgcacagattctgaatttatcttgtatttgattctgttccaatttaatctatgcattcctatgtcatttattgccatggtaactggatactcatctaaaatcacatcaaaattgagtgggaaaagaggaaatacttaactgaatataaattcttaacatgataagaaacactctaatattaaatgaatatttaagcaaacatccatatatggttattggctccctattccaataacgtaaacattgcctcagtttttttttacataacattattttcttctgattttaaagtaacatgtaacttttaaaaaaaacttataaaaaaacttggaaaatacagaatgcataggaagaaaaagcaccaatatttcccatgcgcaagtgtaactcttgccaagattttgaggcgtttccttccagctttgataaatgtatttattgatttagatttatttatttgatgtgaagagcattctgaagggatgacaaagaagaagatgtgatgaaaatatggttgacaagaaagaaaagagagagtaaaacagaataaggtttgtatttacttatttcattggggaaagattctaagaggatgtatcagaactactgactgcagctaacccatgcttaaactaacagtgatttatttatatatattttatatatatatatattttattttattttttttagatgaagttttgctgtctcccaggctggagtgcagtggcgcaatctcagctcactgcaacctccacctcctgggttcaagcgattctcctacctcagcctccccagtagctgagattacaggcacatgcttcaaaacccagctaatttttctaattttagtagagaccaggtttcaccctgttggccaagctggtctcgaattcctgacctcaggtgatccactcacctcagcctcccaaagtgctgggattacaggcgtgaaccactgtgtctggccgatttttttatattgagaattaatttgtccaggcataatggctcatgcctgtaatcccagcactttgggaggccaaggcgggtggatcacaaggtcaggagctcgagaccagcctggccaaaatggtgaagccccgtctctactaaaaattaaaaaaaaaaaaaaatattggccagtcatgatggcgcatgcctgtaatcccagctactcaggaggctgaggcaggagaattgcttgaacctgggaggcggaggttgcagtgggccaagattgcaccactacactccagcctgggcgacagagcgagactccatctcaaaaaaaaaaaaaagaatttttgcctgcttaataagggtattgtggtagtagaaaagatttcatgtgattactcaatgatgttctcatcaaggacatttatatattaccatgccaacatccttaatgggctgacttctcaccccatgctgccaaggtgacttctgaagcccatgacttactacttggcttaaggcaataagacgcaagaaacaacacgggccagtggcatctgttagttttatcaggaaatcagaagttttccttaaagctttcccaacaggtttctcctttcattttgctaaatcaagttaaatttacacttatatctttattagacatcaatcactgctaatcaatgctgtcttccctaccaaaatgaaggttatgaaaatgagtattaacttcagggatttactgttaatgttgttgttttcagtgtgtctggggaaaataagcaagggagcaaatgatttggaattctatcaccttgctagggctactgtaacaaagtaccacagttctgcattgtagtccaaaatcaaggtgtggacagggttggttcctcctgagggctgcgagggaaggatgtgtttcacacctctctcctccgcttgtagatagccatattttctccatgtctcttaacatcatctttgttccacgcttatctctgtgtccaaatttccccctttcataaagaaaacagtcaaatggaccagggtcctctgtaatgacatcatttaactttattacctctgcaaatcaagtaataaatgaggtcacatgatgaggtaccaggggttagaacatcaacaaatgaatttttctcggggcataattcaacccataataggaagtgtcaatgtggataggtggggttccttattctatcttcttgtggagaccgcaggcccagaaatgactgagctgtccacactcttcacttattctgagagcatgcatgatgatagacaatttgggataaagggttaggatggccacagcccatgaattcaagttgaatctgctctccagggccctacctctgaatgccatctagcctctgtatgtactcgaccctgtgggtctccacgggataccttggcacagctgaataaggtacttcctgaacatatgggattacttttttaatgatccaaagaatacctagtgaaaagaattcaataattaattgtaaatgcctcatttgaatacttactgatcaagaaaatcatgttgaatatcctaatatgcctattatgagttttgaatattgtccaaaagggaatgccgtggttactggaggttgaggtaagaaattaaattggcaaatttctttgtaatgcaagaaatcttctcatcctaaaaagaaatgaatatcctcattctctaaagacagacagacagctgacattaggtggtggtataggatttaagtaatatctatatttacatagtcatgaatatgtaacttataaaatgtatatcctacattttacttatttttaggagacttatataatgcatatatcaagtaattaaatattgctatccggaacatgagaactatcagttttaagaaatgagttactgaggtaaaattcatataacataaaattaaccatttttatttgaacaattcattgtatttagtatattcacaacttgttcaaccaccacttaaatctattaatagttctaaaacatttccctcacctcaaagctaaaccctttatccattaagcactttctctctaaccccttctttcaccagaacgacattctgtctgtagcagtttatgaattctggatattcatataaaatggaatcacacaatatgtgacctttggtgagtggtttctttcaggtaacagaatgtttctgaaattcatccctgcctagcatttgggctgtttcaccttcttgctactgtgaaagtgctgctgctgaaacgtgtgtacctgtgcttatttaagtatccattctcagttctttgggtacatacataagagtagaatcctaagatcatgtgataattctatgtttaactttttgaggaactgacactgttttccacagcagctgacccattttgcattcccatagcaatgagggctccaattggcccacatctttgccaacacgtgttactgtctgttgttgttatttttatggttattacagtgatcccagtgtgtaagaagtggccgctcactgtgattttgatatgcatcttgctgatgaataatgatgttgagcaccttttcatttgcttgttggtcattcttataccttcttcggataaatgtttattcaagtcatttacttatttttccattgggttgtctttttgttgttggagttctaagggttctttacataatctggatataagacctttgtaagatacaagacttacaaatatttactcccattccacaggttcccttttcactctttttgtagtgtcctttgatgcacacaagttttaaattttgatgcagtctaattcatccttttttttctcttggtgcataagtttgttgtttttttttttaagtaacacacataccacattcatacaaatggaaaacaggcagtcattcttgaaaatgggataataggataatccttcagagtatcaggatgcatattcataagcatataatcagtttttattttgcctaaatatagtcttcattaactggaaaaaatttatagcattgttacttttatcatatacttgtaatcaaaatgaaataaagatagaaggatatatagtatctctctctaaggtacataatataaaatataagattcttttatttattcatgcatcaaatatttttgagtacctaaaatatactatgattataagacagaaaatttccaacctccattgagcttatattccagtaaataaatgcaaactaatgaaataaacaaaaataaataaattcaggtagtaaataccatgaaaaaataaaatagggtaatgactcaacaggtgaactatttttactagggctactgaaaatgtaacaattgaactgagatgtgtattaccataagagacacctaagagagaatcattccaggctgaggaaattaccaaggcaaagttttgaggtgcaaatgaacattgaattttccagtgatagagaaagggccactatggctcatggagaacatgaagtttaccttggagaagacagtggtggacctgatacgtaaaagaaaaatgcctgtcatttgcttaaatggagattacccgccatttaaataactagagttattcaataaccatttactgggcaggaggctgggcatttaacaatctgatatttgttcagagtaaaggagaagaattgggggtggggagtggatctgagaagagatatataaaatataagagacaccacctttattctttatggaattgtaatccagtaagaattttctaaaaactcagctaaccataacacaaggcagagaagagttcaattaaatatggaggtttaaatcagagaagtttcttaatctagtatttgaagtataagcaggattgctatagttgtaagaaaatatttaaatcaaagggaaacaaagcccagagacaagaatgagcaaggcgtgtctgggaaatggagttgtgcattggagatcagaaggtatttggagaaaacacgtaggatataaagacaatggcattaaagctggaacctatgtgttttatggctttttaattaaaacagatgcagcactcatttatttcttatttccccaacagaatccaactctgaatgtgaggtttgcttgaaaacaccaaagaaatatcgaggaccagttctccattctaattagctctctaagacctggaggctctctgggacacaagtcagtgggacttcagtttcatagactttatgcccatgaagagccagtttttgaagattctctaataacttgaattctcaaatttagattatgaactcttatcataagattctaattcaactatcaagctgagacaaattaaatctgtatctttggtaggcagaattctaatatggtctccaagattccgactctccagcatacataccttgtataattgtcttcacttgagtgagcctccaagttgtgaatataatgggacagtctctcattcgattctgttacattacatggcaaatggtgaggggataggcatttctgtgattatgttatcttacataagattctattgtagcccaccagagagaaggaagacagagagatgtgctgctgccagccaggaaaaagcaaacatccatgttgcctaagggggccgtggagcagggatctgaatgtagaatgtggctgacagctagaagaagccggggagctcagtcacacagctacaaggaagtgaatcctgccaaagtctgtaaagttgaaagagaaccccaagcctcagattaagcggcagcctaggtggacaccttgatttcagctatgtggttatggggcaaattgttgtatctggacttctcagtttctgcaaaaggactggagtcttttttccttcaatattaacatagtgaggaattcctaaacctaggaagtgtgttccaatactgggtgttatgggctgaattttgtcacttcaaaattctggtaatgaagtcctaatccccagtatctcacaacgtgtctctatttgaagataaggtgtttaaaaagttaattgacttaaaatgaggtcataagagtgagccctaatccaacatgactcacgtcttctaagaggagattaggacacagacacacacaaaggaaaaaccatgtagagagacagagagaagacaaccacccatcaacataccacaaagaggtctcagaagaaatcaacctcgctaacatcttgatctcacacttccagcctccacagttgtgagaaaataaatttctattgtttaggccacccagtctgacatggtttgttatggcagccctagcaaactaatacaatgggcaactaaacaagtgacagttatcctctgcacaatccatattagggatgaggagtttgaagacctggaaaatgtgacttagtcaatgtcacataaattttgccaaaaaaaaaatgaaagcattgcatttttaactagagtaagcatacaatctattatcctaactggtatattttggagaatgtttttggtactgtgaataattatgatgggacaagggttataaaccaggttgtacatgtaataaaaagtatcctaggctccctgaaaaagcaagcagttctctcttcagtgggttttgtttaaaatactgtattttacctggaattgaagatgtataataaattattaacaggatgttgccaaatcctattgcctcctttgtgtgtatccaaaggagaaatttctaattttagtaccaaaaataattgtacttctcctgaacaattaattggcttggtttatcttttgtagactatggagggtacaactgactttatttccaccttcaagttaggttgctgggaagcttagcccaaatttgcatactgatgcaaatgtaaagatcagcaaaatatgccattttcttggtctcatttcctgttgtcatctttttttaattttcctttcacctctgcctttttttttaaaatcttgtaatgttttaggtatccttgtaagccaccttaaatcttctggaataaaattacttatataaaccaatcaatcactcaacagtctgatctcattcactatcactgttcaaactttcttttgctgctctattccattaataaaatctacaaatatattccgtctcattagatcatcctgtttgcacgctacgtgtttatagctagtaggtttccaagcctacattcagtcacgtggagttcttaaggttggatacaaatgtagaaatataggaactacctggaagaagcccacattgaattgtaatatctgcacatcgttttttagttaaagtaaatgaaaagtaattttttctcctaaataaaaactgtacaattatatgatttaaaaaaaaaagaacattttctaaactataacaacactataggttgtaattataatgtgccactttactgaaattatcctggatcaaaaagaataattctacatttattacattgtactctgtgtaccattactaaatacagaatttcacattggtctactccagacatacaactgttgaaatatgggaaaatgagagcaattcattggcatgatttcaacaaagagttcttgctgtgttattcttcctggttacattttttctcagacatttaattgtaacacacctgccttatttctcagagatacacagaaacaggatctcctagtgtgtttggttttggactaggactaaatgagcaccagcatttccattgcaagtctaccttggatagctaccccctacttctaatttcagctagataaagaaagagaagtaaactttgctatatccctgctttcattcggcaacacacaggttttgagactttcttatattcagtttttggggaaactatgtgatgcagtatgcctgaatgttaagtacacactgcaaaatatgaataagaaggaagtcattatggactcaattgtgttcctccaaaatttatatgaagaagctctagcttgcaatctgactatatttggagatagggcctttgattaattttaaataaggtcatgagtggagccctaattcagtagtttttgttattcctcatacgagttagttgttgactgggagctgcaaagattaaaaaaaaaaagtcatccttcatggatgttcctgatcttccaacgtggtttcttttaactgcatatttcaaaacacacatttaaatacacatgtacactgggaaagctgaaggacagagaaaaggccacatgagggcatagcgagaaaatgaccacctacaagccaaggagagaggactcaggagaaaccaaacaggctgacaccttgacctttgacttccaacctctagaactgtgagaaataagcttctattttttaagctacccagtctgtggtattttgttagggcagccttagcagactaatgcagagagaaaataagactaatgaaatatacattcataatgattttatttaatactatgcaaattaccttacatttgaaatctaatgacagatctaagagtaggcaggctatgtgttctcaaattccttttataaaggagaatatagaggaaaaaccatttatctgttattactcgcacgagtcagttgttaactggaagctgcaaagattaaaaaaaaaggcatccttcatggatgttcctgatcatccaacacggtttcttttaactgcatattttgaaactcacattcaaatacacatgtacacttgtttatctacatagaaaatgactgattttatttggccctatgtgattcttttcacccagatataacatagaactattggcactggaaaaatatcttcattcctatgctgctttgataaggtagacttaaaataatggcagatacctgtccccatgacgttacagggccttacttcaaggattcaagagtgctctgagaattacagaggtcttttatttaaatccccacaaagtagacgaagagtgacaaacttttgtaatggatccaagacagggagataaaagttgagaacaatcggtgcaacagagtaaaacaaaatgccgcatgatatatgttgaacacaccaatcactgtaagccggcactaatttacttccagccttctagatgtatttgtattcattatattcaaaatgagtatgttaaaaattgtaatttaaattctgttttggatgaccagccacttgcttatgatttgatacattgtgacacttttcattttttataacaatgctcatggagccatttttaattgtactgtaaaaagacttaatttggcccagacagcgatgaaacaccactttctgagtaggcagagttctgtccagtttttatatcttatttacctctgacaggagttgccaacaggggcaaaccaaatacattagagctggctgctgttgtgtcatcttacataaagaatgagacctttttttaaaatgagaaagcttatttttgatagtttagggggaaaggttatcagtatttgagaactacttgtatgtttggtttaaatatcagaagcaaaatggaaggatttgaccaattttaacaaaatttcaaaaagaaatgagtttataagttggagtttaatagcagcaaagtattaaaagtagattaagctttaatgagcataaaggactaggcacaggaaccagatttttatccactttgacactagaatctttagaatcaagtgagaagaggcctagattgcctagggcatggcacccctgttctatgtgttttccctggaaggatggaactagaaaaccaggcaccatttatgacccttccctctaccccttccctatatctatttcatccaaaaatgtggttggtttccattttctctgccaattacctggacttctacaagagccatttattggtctccttacttcctctcttgtttttgccttaaccccctaccagactgaaaccagactaaagcactaatctggtcatggacattaaaagcttttcatagattcccaatggtcccaggacaagcactgcaacctttcacatgacctacctggcctgagtggtccagcacctcccctcataccacgcttcttccccactctgtgacatagctacacaggtttcctttcaattatttaaaataactttctttccttctgcatggaactttttacatccagttcctgctcttaaaacactgcccaccagtcaccttcatctaattaacctgaactcttggttcacatctctgctcaatcatcatgtcctcagaataatttcatattcaaagtaggcccatttcttcttatcacgtgctctcaaagaacctcgtacttctctgtcctaccagttttcacagctacaatcttgcttttatatgactataacatgcatgctcagctacaccactgtagactcatgtacactgtcctattccagagcctagcatagtaacttgaacatagttggttctcagtcatttcattaaaagttaataaattttaccttggtacatttggcgactcattaaaaatttaaaacctttagctttgttccctctcattctaacataattcggtacacatagtaagcacatgcaatttttaatgaaaatttctataccctagggaaacatgatacattcttaatttacatcttaaagaacgtcagtgatatgaactgaggtacttacatatgtcttatggtatttagatattggtgtatttcttttaattattattttaattgtctttcttattgagtcccctcttaagtggagtttaaacagttatgcagctatattaattaaaagattattttgtcccaaaagtcaaagcttgaattttgtcaataatcctttatgtattaattacacacgaagttctaagaaacataatcttgctttaagagatgtggcttgtcaatttagcccaattccagtgttagcaaatattatatagagatttttttaaaagaaacaatgagcatatccattttgaagtatgtagtcccatagtaaagaagataaaaggccaaaatattgttcttaataatataaagagtctaaaaaatagatcagtatgaatttgcaatgcttttcagttaatatatattttagttgagttacatttatttgagcatgattaaccgacttaggttagaaagcagtgcagatatttgtttgggctaagaataaacagaagagatagggctttaaacagattttaggtttgcagtccttgaagcaaatggaatgctgttatgggtttcacattcatgttgcataagacaggttaacttgtgttgtcatttagttttctctgtttttatctgcatcttataccatcctccttatttatatggaccatatatgttatttatatggtccttttgcgataagtacttttaaatcaagtcataaattctgtactcatttaattatttgacatttgggacattttcttttcttacctccctccttatagggttcataaaatgagtgttttattcataaactggcaaagagaataaattatgatgttaccataatttcacaaggaagttacaatttacagataaaatttcacaataacccaatattctgatctgtgtttgaaatgtaggccagaatttcactgtttttcattagtgaaatattcattcctccatgtccagaggaaaaatacattttgtcttccatgtagagcttatgctactgaatttagtaattcctgataagtctcattacagcaagcccaccttgcgctgagttgggttaacttaattgtggctatctttacccatgttaacagcaacactggaaataatttaatatagtctggggcacttcacccattctgtgaactccagataagtcccagatgagctacagaaaggaagcaatatatgatcaggcaggagggctacacttattaacagcaagtgttcagactgctactgggtagcagaacacaaactgcataaatgatcccttctctcattcatttcctggctgtctgactatgtctgttgttctaatgcatatgcaatggccactcgtgtcgccataaagcccattattgtttcttcttaaggttgacaatttttgatgtttttcattttgtaagcttttgtctgcccaagaggtggacattactattatcattttgtaaataacacaaataggttaattttgacctatgctagatgttaggattcttaacctggatcttgggactgtagacccataggtggtggagagactgtgaatccaaagatttaacttcttcttcctacttggttacatgagggagagcagggcttttgacactcaggactcattccctcttctaagtttgtcctcagtggtccctaagactcttctattttgaacactctctgtttctataaagcaagctgcaatttaaaaaaaatcacacatgtgtaaattttttaggtctataggctatttctgtaccactaagcctttgctaacacatcctttcatttgacctcctttcagaaaataatcactaccctgcatcttttctaattgctccatttgccttttttaatgttacaggtaaaccagcattaaaggagctgtagctttctcttcattttttttttcccactgctattggagatagttgtctcaaaggtcaagttaactcctaaattagttgggcaaacatcgtatctataggccatttaaaagaagcactaatgtctctacctgaagaacagaattgggtcatcagctacattagtacatcataggcaatttttctttcacatgctggaaaagaggaaagaggcactagaaatgcaaaatcttccatgattagtttgtgctctggaaaggaaaatgtggacctctgaagtgattagtttgtgaaacattacctttaaaagctctgtaaatcatgacaagttttgcagatgctccttaattctgatacccgaaaatcatcatggaagttatggattttacaatacccgaacatccaagtggaaacgattctcaaggctcactaccgtgtgcctccagagctggcacatgctttgtcaaagccctcaatgccctcctttcccatgaaatatgaacaaggaactcctaaatctcatcatgactcactgttgattttaagctgctcaaaattcaaatgctactgaatttaataaaattttttaaaaattataacattaatagggcaatttaaggtagactccagtttttggagatgcacattattttcaggtgtttcatttcttctctgcctagttaattttatgagttccttgtctattatcaccaaggaggactatgactactggagaacgcaccattcttctctgtactcagaggggaaggaatgaccagttttagaacctacgggatttgaatctattataaaaataaatagaaagaaatatgggtgaaataaagcaagagcagttaaaggacagttgaaagttaggaaggaaggacctaaacttctccaacaacaaataagacagaatccattggcactactcacttagtagaaatcatggtgagaagatataaaagagaaaaaattagataaatagatagatagattgaaaaatgccatagtaacatttaaaaagagttgtgaacaggaaaacggaagcaaaactaaccatatcgaaataaagacctaaataagacttcaaagcaatagattcatttaattgattttaattaaaatcaattaaaataaattgattcaatttattttaatgtgcctagtaattagctcagtgcatgactcatagttaagggttaaattgacacatgaatgaataaataaatgaatgtttctaacctaagctaaagagatcatttattttaataagttctatgccttaagaacaaaaaaaacttgcttataatgtttttaaaatatatactccactgtgtttcctaaagttttctacaacatacaaaccaagaactgttgatatttgtagtagagagtttgtatatattttgttcattaaataagaatgagaggaggaagggtgatagagagggataaatatcccagtgagaacgtgaaggtagacatgaggaatgtgagggctgttgccccagggtttgaagccaacataaacattaaaaccatttaccacattctgacattaagctccttaattgcagcgtccagaaaggtgacgagatgtgaggcaaaacttctgctgctttcttcttatagaatatgctacaggtttcctttataaatcttgtgtcaattggtgatcacttagctcaaaataagaccaaaccaaaataaataaaccacttagcttgttatgaccataacattctctcccataaaaaaaaaaattcactccagattgtagcctttcctcttataagacaacgatctgctgatgaagctacatttctcaaaatatttcacctcagccactgagaaaatcccttcccatcagttctgtcatcaccacgcacaggtgaggcagcatggtggcatgggtaaaagtactggctctaaagccaaatctgtcaccaagttcccaccaggattacatgaatgactaacggaaattatgtagagtgagctgcaaggcacatagtaagcatgcaatcaatggtagaatttattaatattgtactaacccagtcttcatgtgcaatatctactgatgtaatatatcactttatctgttggtggtacttttattctgaagagcactttcacatgcattattgaatttgggaggcaaggatgcatctagttagcagtttaacctcaaacagtcctgttttgaaccctgataccatttatcttcatgaccatgggtaaagtcattcaacttctctgaacctcagttttctaataagtaaaattaagattataacaattcttgttttatatactagttgtaagatacaaaggaaatgcttaccataatacctgtatttatcgtggtatgttgtctttatctgttcgggctgctatcataaaatgccttggactgggaaatttagaaaccaaagaaatttattgctcacagttctggagactgggaagtccaaaacctaggtgccagcagatttggtgtctggtgaaggcttgctctctacttcctaaatggtaccttcttgctgcattctcacatggcagaaaaaatgaacaaggccccttaggcctcttttataagggcaactgtaatgaatattcttacctttatggagccctatgacctaatcacctcctgaagtctccacctctattgagttgcagtggggcttaggtttcaacatatgaattttgaggtgggaggacacaaactttcagacaatggcaactgcatacattattgttgttattattgcattcaaccttataatcgccagtcccaaaacaattccgctgcttggatatgtcaatacctctatgactcaacagatctaaacttaatgtatcccataagctaaccttcctcctaaattggtattttcatcatctttccaaatatacttatttgataagactttatctcatctatcatattgaccttttatatcgatgaggaaaaaatcagagcgtttatgtgggttgccaatggacacacagtgattagagagaagtgagctgatttcaggactgaattcagagctgtttttttccctccgctgctgcagtttcctgttactttttagtgttacacaattgcaataggtcatctaccttagtcatcctttaactttgagtgaataactataagaattacacatatttttcatcttttgcattgacaaagcatccagtctaacaaaatctctcccatggccttgtaataaaatgtgctttaaaataagtaccacacaaccattcattttgggatatgaagtaaacataatgttggtacctgctgagtaaattgtttttcttaatgctatgtctttgttacttttctccggtaaacccaaaggttgatgtactttaatgcaatgatgctaaccaaatgcacaagtaaatgacaaatgcaaagcacactgctaagtggtacacatgcattgtcttgtactagaatacagttacctcccccacaagactaagcattctccccataaacttctttcctatttaaagagattagttgcattgatacctaaaacttatttgttatctaacacataaacaaaatctgttacttacacaaacaccacctttccgatatacacacacacatacatacctaagtctcacaatgtaatgcttgggaaagtaaaaataattagctctacatatcactcatagtggctttattgttccttgtgaaatcaacatttaagcatttgagacaaagcccactttatgcaaggactgaattagtacgttgaattgtgtgttggactagagtttcttgggtttaattagagtttttgaggtttttttctagtaaagcataaagctccaagagtaacaatttgctggcaaaatgaaaatactctcatgcctatcctagatcctagatgttacagaccagaaaaataatgttttaaaatgatagaataaatactcaaaacaagagactggaaccaaaatgatgctttgccagagggtctgatttctaccccttcccatttcttctgaatccgtctctcaaaggtctgcaatgacctgaacacaaaatgcccttttgtcctcagacctcattttctctccctctgagatggtactgcatactgtttacaagtccctttctctttaaaccctctcttttatacattagttcattcctagaatgtcctatatcaagatgttctatgtgccaggcacaatgttaggtgttaggaatacaacagtgaacaaaacaggcaaaaatctcagctttcccaagcactgttttgcccttttaaacatcttcaatgtacttgcccctccaagtttctacccttggcctcctcttttcacttggtgctatctaccaatttcacctcattcctccattctgtcatttctcaacgtttcctttctgcaaaagatactcagaattacatctatatgtccttcatctctcaatattctccacgttcaaaatggtgccaatgtttagatacagctgcacctctgtaactcaactgaaatgagttccaaactgaacttttcccccataaattaagcttcttgcaaagaaagtttctatttctgttatctttccaaatacccatgtataagaggactctgtctcttgtctgccgtatctcatcatgtctcatagttttggttctgtatctgtgataacattagaattcattttcattctctagccacattttgactaatttaatattttccggagtaactttcctatctaaaattgttcatttttccagtccaatccatgctttttgcacaatgaatcatagtctgataattttcgcaggcttctcaaaagccttcagctgcttcttgtgatttaatagataaatgtctggccttccaatcaagaccttctctggaggatctctttctggcttctcctcacaacttccatattccaccatctggtgacataaaactactcacctattatccataaagcgcccatgtattctacttctaattgtagtaatttcattgttcctctaagctggaatgtcagatttcctactctcttcattaaaattatccacgtatactatagtaaagatagtatcctcccataaagattttcataattttcctaaattacaagtcatctttccttttaaattaataatatctatagaatctatgttaagattataatatcatctactcaattggactagaaccatgcacctacatttgaaaaataattcatttaatggatttggaagaatatatgaagaaaaaggcacaaaatgagaagtacaagaaatcagaatcctgatgccaagattacaccaaaaatttcatatttttgcttttatcattagtgtctatttctattgctaccactctcatgtggcagagaccataattaatggtaagatgtcctaatatatctaggaccaaaaaaaattgaatttccagtgaaactacctttgctgaactaatcagaacccatgacactgcttatggagtttctaaataaatctactttcaacgacacggcaatgaccttaaagtgttactgcagagaaaaggatttcccgagacccactgaggaacggtactatttcctatcatctttaaaaatggaaatagccttactgatatatactatcaagttattacctatttactgtaaataaaaatctgaaaatacctaaaatgtgaagatagaagtgaaaattatctataatctcactaggctgctataatcactgtgaagatttgatatctctttctaggatatttgttctgcaaatacatacataaatattttaaaaaataaatgaggtctaacagtacatgctaatgtggaccctgcctttttcacataaactatattaggagcatattctcctatcagtatatacatttaaacctgcatcttcatgttcacacacttacagtgtatgacaacccacaatttaattactcatctatccattaacgaacatttaagaggtttatattccctttcaaaactttttctttaaattcagctattaaaacacttcactaaacaccttgaacactcatactagaaggatgaaatatgaaagtatagagatttgattctttaagagatttgatcggttatttctttcccaactaatctaaataatcttggtagcttacgatggacacattgttatgtgcttactgaccatttcagggttttttttttttctttccttttataattgcttatccttgtgcatagctttttcttagaggggttattctctttttctacttgatttacaaaagctccttatagtgtcattactaattcattttattgcatatatgtttatcatttgactcttaatttgttaatagcaaagctatggataaatatgttgtcatataagtgctttaatttcaaaccagttatatctcctaatcttatacatttttttttcttttgagacagtctcactgctcccagtctggaatgcagtggcgggatcaaggttcactacagcctcgacctcccaggctcatgtaatcctcccacctcagccttccaggcagctgggactacaggcacgtatcaccatgctcagctaactttttttgggggagggggcgggagtgggggagatggagttttgccatgtggccgaggctgttctccaacttctgggctcaagcaatcctcccaccctagcctcccaaagtgctggggttacaggcatgagctaccatgcacggctaaccttacacttgaaggtttgccctgatgccacccttagaacaactttccttatgatttccctgattaagccatatagtattcattttggtataaagtgcaggggagaatatatctttgtttctctccaaatgattagcaaattgcatcatatttattattatactaacccaatctttctcattctagtttaaaaatatatatttagcccctttgtcagctatcaatagagctgttacttatagtggcacagatactggaatgttgttattttatctttataatacactataatatctaatagggcaaatatcctcacctccgtgagagatgggatgccatctctcctaagtctttttgcttgtttccagattttttgtatctattttgttctacagttgaccatcaacttttcagaatgagaacttctgattagtaccctcaagtagaactatgcctcgtgatcctacatcaaccaagactatgatactgaccaaaatgccactttattaatttttaattaaaagttattgtcagaggtattagaataattcacattctttaatcagcagattatcttactatggttaagtcaatgatttcttttcaatgagaaattttcatcttaattatttaaactccattaacttcattctctccttttatgcagtacatgggaaattatgattggaaaatttcctagtgagcagagaatcagatgatgatgacataaatacataaaaatggtgaattgaatcagagttaccttgatgcatccattacccaatacagatggtcgaagcgatggaatgagaatacttggagtgtgtggcacaatgttcactggacaatagacaatgaatgcttagatgggcactggtgatattagctgtggtattaaatctgtgcttctttgtcaagtaagacttccagtgggttcattcatcaaacagcccagtcttgctatttcagtgagtgttttctctttgtatggttttgctcacataagatttagtcccttgctactcaaacatgatctattgaccagcagcatcaacattatttaggagtttgctaagctgtcaagtgccaccccgtatctactgaatccaaatccactttctcaagtgactcatttgcacagtaaagtttgagaaacactgactattccataacgaattgatcttatagtttaacatccaaaacaataatcataaatccctagtttcagattcataggagcaccttactgtgacctccatgttatgacaatagtaagtaccatggtttgtgaataataaatagcagtaacccttatttaatagtgaaaatgcaaacagccatttatacctagcaacaggtcctgcattctagttacctggtatggttaggctttgggtccccacccaaatctcatcttgaattgcaatccccaggtattgagggagagacctggtaggaggtgattggatcataggggcagttcccccctgctgttctcatgatagtgagtgagttctcacaagatctgatggttttattagtgtttggtagttcctctcttgctcacctcttctttgtcctgaagctttgtgaagaaggccatgtttacttccccttccatcataattgtaagtttcctgaggcctcctcagccatgtgaaactgtgagtcaattaaacttctttcctttataaattacccagtctcacatatttctttagagcagtgtgaaaacagactactacattaccctttcgagttatggtataaaaacattgtcagtgtcaagaaaatgatgacaattcgcaattgttccatgtttgtacattttttcttatttctcctaaaatagtttaagattctcattttgcatttcatgtcaagttctgaagttgtcatattccactgtacagctttcctaagctttgtgtgactaatccaacatatgtgacaacattggtttcatttttaataagttcttaagtccttaaaaaaggggagaaaataatagctaaagaaagcaagtcttctagaggagaaaatgacatgattcttaaataaggttttgctagagtaacgtctgtgttatttagtggatctgggactcagaaattctgccaaagaattctttgtctctctaattcacttggttagctttcagaaatgctaacaactattgactagactttcacagtatgtcagtctttccaaatgaagaaaatggagggtaagtgagctgaacgtgttctttgcctagggatgactgtaggatgtttattgaccagttatgtcattaatcactttttatttcaactgactaagttcttctatggtgtatgagttaaaagctaaagttgcttaaaagtattgagagaaggaaaagaaaacaagaaaaatacctagaggtggtgtgcagttgaagctatttctgtccttacagagtaaagcaaattatttcaaaatgttcaagaaatataggtgccatggattttctgcaaaaatacaggcacagaaatcagagacttttgcaaacactacactttgaactgccaaaacaaaaacagccacatggcaacatccttgtccttttattattgtcagtgaatctagccttgaagaaaaagtgtcaggtaaaattccaagggccatctgcgacatcacaacagggctttagggtagaagatagatagcagttctgtggatacaagatccctatataagttctctcacattggataccatatctaacccaacttcattaaactccatgaaaagcattgtgatttgcgcatagtaagtgcttgaataatattttgttgtaggaagaagaaagaatgagcaaggaagggggttaacatgttctattaaataaatgggagtgttccttgtaatatgagaatctcatttttacttccaagacccgtccttgttcccagacactgtcaactttctcagttgttcacagttaatagagactattgacagagaatcgtagaaaagcttattgatatcatgaagctcactgaggttgaagagcaaaataatgaaatatctcaaatcctctcaaaggagcaaagttataaaaagcttcatatagagatgaagatcaccctctcaccacattgcacgattttctttaagctctgcacataaccgccaacttcctcctgcccctatcaatagccatgattgtgggatacagaatgagcccgactgcgaaaatgaacttttcactgagttcaggatgtttttcctgatggtctcacttgatagcttcatctttttgttttatgtcttcttggcatatttatgttacccagaacctccccattaaggttccaaaattctccagagggatgtgggcactcccatttccttagaattaggaaagttatattgtgttctcctccatatcctcatagccagtaaaaaaaagttaaataaattaaaaattacaaaaatgaagcccacatttaaaataacttgaattaaaggaatgtaactctatgtaactctaaccataaaaaaagacagatgaaatgttgtaaggctgaagaacgtatcaatagcaaataaattaaccaacaaaggatactaactcaaggttaataaaaagaagtagaaatgtcatgtattaagggaaggttcttgacctatgcatacctaatgttcatttttgcagaagtaaacttttttagattacttatttttatgaataactttaataatacacactaagttttgaaaagtagtaaaacctaagaataaccataaaattctacttagcttttagtcactcatttatttctatcatggctagtacaaaacttgcctcttgtatttatgataatactttctcagtaacttaaagcctttcagcatttatgaaaacaaatcatcgatttagagctacgagcatgctatgcacagaggccaggtttttgcaatttaattctgcagacgtggtcttcatcaacatattatacacaactattaagtgactcggtgttttcttaacaatgtactaatgatcaaagttgttataatgtcatttcttccacttcgtgtcaccagaattggaaagatttaaattgtgcatgaacgaatatcacctacactattggaagttggttaatcagatgtccactcttggtaccttatcccatggaatgcccaccataacccaatataatgctctcacagattaatgttcacacagatgcttatgccatgaccttcagaacctcagactgtttacctacctgtatgtggtagacaatgctagctctcaccaatgtttttaattccagtatatcaaaagtccatttcccagaaacattgcagtgcctgattctagaaaattggctgggaatggcagtatgtagatgtcaatatgtgtctctccaaggtcctcttttcctgccacagcaaaatgtgacagtctcctgcaaaatggagatggtacaaacctacaatgttgagtaccacatggcagagagtcgccctggagagttacccagacccagactgtgaaaaagatttttcaattgtcttaagccactgagattttggtgattaccccagtgcaacctagattttcctgactaaaacagtaatacaaatcttttattttactatgttatattcttatatctattcccataatgacagacttctgcagagtaacttgctgggatttccagaatagtctgtcttgatagaacataaatttcctcttatatgaaggtaactctttcatccctgacctcttttctaggctctcagcagttgagataacctgcccaaattggaagaatattacaatcagaagggggaagacatatctgggtcctaaactgtgacatgtgaatatttcagaaatatttctgaatatttctattcacatactgacatgagggtcttttcctttgtccaagtaggatttttgagttgaacattttactgatattgttctaacataattttctgcctacttgtgctctgctgcaaaaatgggtcactccctaggaactctaagttgaaccctctttacagcgtttgatattagcaatcggctattccctgcttctgtgacagtatgacaggtttattctgggatgataaattgaacgagttcatccgtatttcacacacaaacccctaatgaaaaggttagcaattcattgtttgaatggaggatggattggagagaacacgtttgtgtgtttttgagggtgcctgtgctttagatccctcagggaacactcaaaactggatgtcagcatttattctgtgaactctttgggtgttttctgttgttgttgttgtttaatcatagcttaaaagaaatgggattcagttagatcctattagcaatttctagtgacaaccttctttctcctttttttctaaggctaaattgatacttaatataataataattattttttgtatgggtatgcagacgtgaatactggaaaaggttctttgaagaggaacatgatgcctatcattgatctgagccaggtaaaattatccatagaatcttgctccctctaaactctgaaaggccatctattcccaagaaagatcagttgacacggacttttatccctgcaggagatactagcttcacagcccaaagagagaattgttcaggatctggaaagacgagacccttgctgtctttgtttccctccgtcccagcttctaacattgcaggcacctcacaggaaaaaaatacaaaaagaagacttgatcaagctccaggtatggaaagtattttcacaattgtaagatgagaaagatgggcaagactgaaaacacatccctttaatgtttagaaaatgatcttcctctgaggttaacctttacaatgtttcctgcatttctcctctagtctcatacttgatctcagtttgtatttaccatgtttttagctttacacactgtagtaggcagaataatggttccccaaagatgtccaagtcctaatgctggaaactgttaatatgttacgctactttgcaaaagtaggactaagcaggtaggataaaattaaggactttgacatggagagattatccaggattatttccttggctccagtctaaccacacgggtccttacaatttcagaatctttcctggctatggcgagagagtcatctgactacggaaaaactgccagagacaggcaacattgctgtcttggagacagagggaggaggccatgagagaaagaatatgagaggtttgtaggaagcggaattggcaaggaaacaaattttttcctagaggttccaaaaaggaaccagccctgacatcttgatttcagaccagtgaggcctatatgcgattttgaattacaaaacgataacatgataaaactgtgctgccttaggctactgtgtatgtggtaatttgttacatcagcaatagaaaactaatacatacaccaaaactgtgcaaatgagttcttattattgtatcttgaaaacatcgtcctttgggttatctattttggttagttatttagaagatgagattccagtttaccagattccaaagcctatgtttatttctttttgtttttgttttccctactttaccgtgttgtgtctcatttggtatacaaaattaatcatgcattggtttcaataaattaagcatcatcatccagatctgacacatttgatcagacagcgaagcagcataatgctcaggtgaagagaaggagattttgaatgtggcagattcctctagaactctggctctgccaattactatctctatgtcatttggccactcaacttctctgaacttcagttttttcatctgtaaagtgaaaataatatttgtagctgttttgtagggtgtgagaattactgccttaatacatgcttttgagaattcttagcacacagcacttaataatgctaattgtttttatggtggtggttatatgtcattatgattcgagtcacgtctcacacgtaagcaaataaaaggaagatcattttgattagtcacagttttgtggcctcagtgtggattctctttttcaaaaacggcttttccttttatgctgtctgatcagcgttttatgagtctccagatcaccccctctgggtgctcacaagttattttatgttcaccatcctcctttcccatcacaaaccttgtgttcccagtttctgaaagattccgtgctttaccctaaatatctgataattgacttgcaaagaactgctacttcttagtgaatctccacccacgcaggtaaaaccagaaccctctattaacacaacccttatgatgtctttctcctattttgtacagttatctcgaccacaaacgataaccagggcccttgtaacattacaacagaattacaaccatcctgaaaaacttatgggaaaaacgcctgattcctctcagggacaaataaatcccagactcaggacaactttgctcactttgatcagcatgggaaatttttatcatggaaaagccaaacatcatttctgtgaggagttagagactctctagacctgacttctgttttaaaatcatattaacagattcctttgacagtctcaggatgtgatccatttattaaaagtctgttatcattgtggagtgcaatgattagcaaagtctttgtagctaacaggagacaaagatatcagtgtgatggcaaatttagagagctgtgaacttattctggttttccttgtggcagggcccaagagcgcttccttctctcccctgctatttaattacatccatctcataccaattgtgaaatttgggctgcagaacaattatacttttgctggttaggccaggctgtatttcgtcaaaaaaaatttaatatagtaatctgagttctgtctacagcaaaaaactgagctttaataatcacagaaaaaaaagaaagaaagaaagaagaaaataggtaggcttctgcgcaaatcccattttttataaaaagagatctactgggaactttctgctcccttgttggcttctagatatggaggaagtttctaagaaagagtaggaatgatctttggaagaatgtaaggagaatgagtttattggtcaatgcgttaaacctgtaaaatggagatatttggcatgctggcccaaagaacttgaatttgaatctttacaacactacttagaaactgtgattttagaaaacttaaataccttttatgggtttcagtaatttcatctgtaaagagaaaaatactacctgctctattcaacaggggtgggagaatacaataatacaatgaccaggaaagtattttatgaaatataaagtagtcatttaatttgagggtttttttttttttttactacatgtaaaaataaatatcctatttctggaactgaaagagacattttaggttatctagacttaatccttaatttcacagtgcaagaaatctatctagagatgagatgagtcaaccaggtttggagaatgagtcagtggcagaaggatacaagcacatttacatttttagctaaaagacacaagctctgtcacttactacaggcagaaataataattcccaattcatttggtaaagccagcattgccccaataacaaaaaaattacaagaaaactacagactaataactttattgaatacagacacaaaaatcctgaacaaaatgttagcaaatcaaactcagcaatatgttaaaaggataacaaaaaccaagtagagttcatgcaagtaacgtaaggttggttgaacatttacaaatcagtcaatgtaattcatcatattaacagagtgaaaaacatacaatcataccaacacatgcagtaaaggaattcgacaaaattcaaacccattcataacaaaaaagaaaacctttcaaagaagtagagagagcaggtgtaatcatgaaggtgattttggatgagagtaacatttaaataggtagactttgagtaaagcagattgtccacaatgtgggagggctacctccaatcacttgaaggctttaatataacaaagactgacctccccagggcaagctgttggtgaaagataaacacatagaaaaacagagcagaagaaagaacacctagaaatagacccacataaatataataaattgaactttgacaaagacataaaggcaatctgatagaaaaaggacagtcttttcaacaaaagctgctgaaagtattgggtatctatatgaaaaaaaaaaaaaacctagacacagaccatacactttttacaaaaattaactcaaaatgaatcatagacttaaatgtataatgcaaagctgtaaagcttcgagaagaaactgatgaccttggtggtgatgtgtatttagatgccataccaaagttaggtttcatgaaagaaacaattcataagttggactttattaaaattaaacatccagagcccataaaagataataaaaacaagtcacaaatgtgagaaaatatttaaaaatcacttgtatcccaaatatagaaagaactcaaaaattaataataaaaaagcaaacaatccaaatttttaaatggtcaaaagatctgaacagacacctcaacagaaaaaagttatggctaaaatccaaaaaactgacactatcaattgttggcaggcatgcagaccagcaggaattctcaatcattgctagcaggaatgtaaaatggtaaaggcaattcggaagatggtttgatattttcttacaaagctgaaatcgacttaccaacaactgtactcctaggtattcatccaacctacttgaaaatttatgtatatacaaaaatctgcatgcaatatttatagcagctttatttataatcaccaaaaactgcagcaaccaagatgtccttcaataggagaatgtataagcaaactacgctctatgcatgcagtggaatgagttatcaagccaggcaaaaatataatgaattaacgcgattgtgaagtgcaagtcagcctggaaagctacacactacacggtctaatgtatatgacattctggaaaagccaaaactgtagacaaagtaaacagatcagtgcttgtcagggtcacagggagggttgaacaggttaagcacgagggaggcagattttttaggaaaattaatgtactctatgataccataatggtggatacaggaaacagttcatttgtcaaaatcaacggaactctacagcacaaagaatgaaatttaaagaaaaaattatttatggggctaggggactccaagatggaatgcagactgaccagaaaaaaattaactgtattaaaaaagtatggaataacctcactgaagagggtaggagaaaagatactgacttaagtaactttgtaaataagtagaaaccataagactaaaagcaaaaaacttttcttaagtactgtactctgggtagtaaaattgtttcctatgggggttcaggttaactattctgaaaccagtatacatgtatgctgaaatggaacaattaagtaaattgcctgcaggtggtgggagataaatttctcattgttggaaggaaaggctatagagaagcaaagggggaaggctagaatgattcatgtgatactagatcagtttgagacatcagtatgaactcacattgacttaatataagtatagatggaaacatacacacacacacacacacacacacacacacacacacacacacacacttgccaattgaaagggcctggaatctaccacaccctagcagcaacaatgaacctaaagtttttgtttctaatatcaattaaagggactagggctctttgaagaaatgtctgattctagggccagaacatggactatataatctgaacctggaggttttttgtagtgctagaaagcaaggaaatactaaagcacacacacaacaaagggacacaggaatcaacctaaagaaatcccagtggccaaagctgggacaatttgagcaacagaataaataatgtggcattattttataacccaaagtataaaatatctgtaagcccatgctgatacaaacaaatgattgcataaacaaataaatagggaagacaaggcgcctctcccatacggaagaatcccaaatgctttatgtgtaactctcatcaagggggtgatgcagaactccccaccctttatgtacagcttgagtatagtgacttcattccagagtgaacaatatggaaaacagggcttggaagagtaactttacaaggaagaaatctgataaacactacttcagccaggtgatcaagttcaagtcgatgatgaacttgaccattaacaatgataagtcatgttgatagcacataccctaatgtgatatgatgaagacggcattttacctctgtagtactcctctataaaacagtaacatcaatgtaaccacaagaaaaacattagctaaatcaaaattgaaggtcattctatgcaatgcttgaccagcacttctcaaaactgtcaaggtcatcaaaatcaaggaaagactgagaaactgtcacagccaagatattggtgcattagtttcaccaagattattggtgcctcaatactggtgcatgagttgacaaatgtaccacactaatataagatgttaaaaataggggaacctcggtgtggggtatatggattttcacaacttttctgtaaatataaaaccattcaaaaattaaaagtttattttaaaaatatacatgcttcccaccacttaataactgtggtatcaactgtattactttaaactctctgagaatcattttcctatttgtaagctgggataatcctgctgcaaggattataatacacgtaaattccctatcacagtgcatagcacatagatgttaataaacattagttctttttcttctctttccacacataatactatgcatttcaaaatacatctgttctatctttttaaagaagggttcattactattttaaataaaatcattttctcaaaaagaatatttaatatcgtggcacaatttaaaaactagtttttggagattcctagtatatcgcaataacataataattgcaaggagcaaatacaatctgtctctattttatgataaattgtctatagtaaaaaatggactgttaattgcataactgaagttatagcttatcaaatcaggccatcaacattaagcctatgattgattccctttttagggactggagcaggaagatgtaagggcctatttagagttgactaagctaagaaagacatggaggaattacatgaggacccaacatttacagagacagcttcaatataaaatatgcaaagatgcaaatttaaacattacctggagaatttcagggtgtaagaccacagaacattgtttcagcaaagggagcagtaacatgatacagttaaataatagaacactctaattatctagaaataagtttgaaatgcctaaggtaatagtgcctgcaagctcatagtattacagaaataattccatttttcaaaattaaccaccaaatttgcatgaggaatatccaaaattgaaaaaaattgcctggtgttgaaatatgcatttttattttgatgttaaacctttcgaacacctgctttaacaaactgtctccaagtgaagatgtacatatgttatgtattttatgtcataaaatattagaaaaggaattatactggtaaagtgaccaatatattatatgtgagaataacttaacgttttaaaacacttccacatacatcacttgtttcttctcaacaacctcattttgagtcacatttggctccactcccattttatagataagtgaatgtaacctcaactaacctcattacacaagcatttattgtgaaactactaaacgccaatgcagtatgctagctgccaggtgtacattcctaaataacactgacatggtccccaccactgggaaactcaactccagatgactttgttttatcatgtcacagaccaccctgacagattagtggcactgccagattagtggctgctgcacatctgataggatccccagaagacgacgctgctcccaaagacttgggcatgtcaagctcgacccttctaaaaggtgtgtggcaaactgatgactgcaccccagaaaatgttgcctcagctccctgttaatctttcttctcttcaaacaggggataccagcagtgctcaagctcaggatgaaaaaggagaaagtaaattttcttctctcttccaccatgcaaaccacccaccaaataacccagctttctcaaatgtttaacatggtagtaaatttatcttccttaattctaatatattttggaatgaaagattatcttttggtcaatggttaggtctattatgtacgaagaactaacttgaccaatattttcaaaagccagacaatggcaagttgaaagtggtaatgcaattattcccttaaaccttaagacaaaggagaacaaatgcatttatttacatgaacaaattttttattatggtgtttgaagctcacactttttattttaaagcatatattaaaattggagctagtcatttgagctttgaaataaacatttcaggacaatagatgcacacttgatgaaaagctgacctttgcagtacatatcgacattcacaaaaaaatggaaagatattgacacagtgcaaacatttttcttttcttcttttttcttttattatactttaagttctagggtacatgtgcacaatgtgcaggtttgttacatatgtatacatgtgccatgttggtgtgctgcacccattaactcgtcatttacattacgtatatctcctaatgctatccctcccccctccccccaccccacgacaggccccagtatgtgatgtttcccttcctgtgtgcaagtgttctcattgttcaattcccacctgtgagtgagaagatgcgctgtttggtttttgtccttgcaatagtttgctgagaatgatggtttccagcttcatccatgtccctacaaaggacatgaactcatccgttttcacggctgcacagtattccatggtgtatatgtgccgcatttgttaatccagtctatcattgatggacatttgggttggttccaagtctttgctattgtgaataatgccgcaatatacatacgtgtgcatgtgtctttatagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcacatgtctgttggctgtataaatgtcttcttttgagaagtgtctgttcatacccttcgcccactttttgatggggttttttcttttaaatatgtttgagttctttgtagattctagatattacccctttgtcagatgggtagattgcaaaaattttctcccattctgtaggttgcctattcactctgatggtaggttcttttgctgtgcagaagctctttagtttaattagatctcatttgtcaattttggcttttgttgccattgcttttggtgttttagacatgaagtccttgcccatgcctatgccctgaatggtattgcctaggttttcttctagggtttttatggttttaggtctaacatttaagtctttaatctatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtagtattatttctgagggctctgttctgttccattggtctatatctctgttttggtaccagtatcatgctgttttggttacggtagccttgtagtatagtttgaagtcaggtagtgtgatgcctccagctttgttctcttggtttagtattgtcttggcaatgcgggctcttttttggttccatatgaactttaaagtagttttttccaattctgtgaagaaagtcattggtagcttgatgggcatggcattaaatctataaattaccttgggcagtatggccattttcacaatactgattcttcctatccatgagcatggaatgctcttccatttgtttgtgtcctcttttatttcgttgagcagtgctttgtagttctccttgaagaggtccttcacatcacttgtaaggtggattcctaagtattttattctctttgaagcaattgtgaatgggagttcactcatgatttggctctctgtctgttattggtgtataggaatggttgtgatttttgcacattgattgtgtttcctgagactttgctgaagttgcttatcagcttaaggagattttgggctgagacaatggggttttctaaatatacaatcatgtcatctgtcaacagggacaatttgacttcctattttcctaattgaataccctttatttctttctcctgcctgatttccctggccagaactaccaacactatgttgaataggagtggtgagagagggcatacctgtcttgtgccagttttcaaagggaatgcttccagtttttgcccattcagtatgatattggctatgggtttgtcattgatagctcttattattttgagatacatcccatcaatacctaatttatggagagcttttaggatgaagggctgttgaattttgtcaaaggccttttctgcatctattgagataatcatgtgttttttgtctttggttctgtttatacgctggattacatttattgatttgtgtatgttgaaccagccttgcatcccagggatgaagcccacttgatcatggcggataagctttttgatgtgctgctggattcggtttgccagtattttattgagtatttttgcattgatgttcatcagggatactggtctaaaattctctttttttttgttgtgtctctgccaggctttggtatcaggatgatgctggcttcataaaatgagttagggaggtttccctctttttctattgattggaatagtttcagaaggaatggtaccagctcctccttgtactctggtagaattcagctatgaatctgcctggtcctagccttttttttggttggtaggctattaattattccctcaattttagagcctgttactagtctattcagggattcaacttcttcctggtttaagtgcaaatgtctttaaacagtcatttagcctgtccattattccaaataattaggttggtgcaaaagtaactacggctttaccattaaaagtaataactggtttgattcatttcatttatattagcttgtcagttcattcaaaatcgttaaactcctgctggtgtgcaagcacaaaatggtgtcattgacttatttgggttctcaagtgtacggtaaacaactgaaaatgggcttcatggccctttcaccaactagagaattaagcatccacaggggagaaagtggtttgaaaaaataaaagcacagccaagcaaaaaatgtgttttgatttttaagtgcaaagtccaaatttgttttcagtttgtctctaaacctctttcagagtttttctcctagaacctcctctcccctgtgggatcatactgaacaatgttttgacgtctcagtcatttccataacagcagattacagaaacaagacaagcagtcaaacaagtaaaatggtttgaatttaaaaacagttctggatcactacgaagacagacatggaattgtaccctgcttgtggagagaaaaactactgatcttttctttttactgttgataattcattgaaggaaaaaccactatgactttgaaatttactcttattgtgctttttttaaaaagttatgttgttcctgatatccttacacatttttaagttcctttcccacctatcttttcttcctgccattccatcccattgtgattcttgctaaatttgccagttggaatgtgaaggctaaattatcagtactgatgtgtcagtatcactcagagaaaaaggtgccaatatttcatcctagcagtcatcattcccataaaaaaacacactttgttgaaaacaaactagttgattatacaaaacctctactaagataattggttatttacatttacaaaaaattcaatatagccaaaatattaaggaagctgaatttattgaagagtttattcacaacaattaaacctggttgagtacgtatgcagcctcagcgagttactcataatgggaagagcatggcttctggaatataatagaccaggattcaaaccctcggcctaaaatgtacataccgttagcctcaactgtaaacaaaacttatatataaactctttgagccttaattactccattgaggaaatgaaaataataccaccaaaggatataatcatgtgctgttaaaccaaaaatttgaaaagccatgatctgcagcatttgtcagttccatggtgtaatactcacacaatggccattttcaagctagcaacgtaacatcaatgaatgaggacttgggaagagatgcacagaatcagccctcaagagccaggatgaatcagtttcaacatagaaagttcttacagcaaaatgatccttaatcttaaactggcacagtaatagtcattcaataaatagtttttattgttagtataattattagccaaattcacaaggataagtagcctatcaattcatacctgatccaaaaaacaatgaaacatctagacaataattgaagttctatatcataggtacatatggaatattactgaccttgggcaacactgtcaccctaagcctaaaattattttactttttcttttgaacacaatggaggcgttaaatcatgtggatatcagcttttctcagttgatgtttccaaattattggtcccagattatcaagacccattgaattgaaataattgcaattatttcatcagagtattgaaggtatgtatcgacagtgtggcaggcaatccttgcatatatagaatcagcatggtgtcaaagtgtactggcttaccaggtttatgcacaggttatcataaaccagagatttattatgggaagaaaaagtaatatccaaacaactgtacatagctagagtgcttcccccttttattgtgtgcttgataaatcatttattatgccagtgaagataaagcaaaatttacatgtccctcaagtgttgttgtctgtagtaaataatgctgattgaactatgcatcaaaaaaatgaaagtttataacctcatggaatacatgcaactttgtctgaatgaaaaatggaaggttataaatcacagataaccacattgtgaaataaaatatgcaagacctcccttacatgagatggagttctgtcctatttatttgcttgattgtgttttggcaactataatctttatggcatagctggtaaggccaatcatgaggaagtcagctccaaacgtatattaaggatttattttagtcacctctgcttctcttctacttggggtgggggagtcataaatatggcccgcccatacattaaattgcttagtgagccatagatttaagctgagaaaaggaaaagcgaactcatatattattaaattccataaaagctattaaatcagctaaggagcacaataatagaaaatgagtttaagaaaaactgagttttttattttgatttcacttgaggaagaaaatatagatgctagagctggttttgctggaaaagtttccatgttgcataaatatatagaagaaaaagctaattctaaagaaagagaatgcattttaatctttaatcatcttcttgattttagtaggcccaaatttgaatgcttagacaacaggcattcattaggaggtaaatatcaaatacccactttatatgaaaacaaacaaaaaaatgaaaaaaaaaacggaagaaatttagggtaaaatggcagatgagacacaatcccaggtttcaaggaatatgcaatcaagttagggagcaggggaataaggcagtatatctaaacaaggcagaagacaagtgttgcaagagagctacaaacactgctatatgaactatcaaattcacttgtggaatctggttaggattttaaaagaactgactgttactgggccatgaaaataagatagaattttaacagatgacagttggggcgggagaagatcattacaggtggaagatatagcaaaagaaactaaacatgggacatgaagggaatttttttttttagaataagaaattttccaataagcacaaattccaagttacattagacttccaggactggttcaaggttgtgaatgccaggataacaaatcaagaaacagttaacttaaagagtaggagaccggtcacatggagcatgactgatagaactaaaaaggaagcctgtctaacatttctgtattccccttgggctttcagaagtccttcttgatcccagctctctaacaagtaggtcaaggggttcacatgccataaaaaatataagcaggttcattgttcacttgagtgaaactccggcatacagtctgtaggaagtaatgagaacctccttactccaattatcattattctccccatgtgaaaaaagctttcttcctccttgcccggagcctgtacttctgatggagtttccaacagtgccaaacagcaaggcataattccattactcctggaactattcttacatatttatccctgctgatatttgtgatctgaaaaaggtagtttgaatacagatgagcccatgtgatatgaatataggttttgttttgcatcatttgactaaattaaattctaaccagaataacaaaactccatttttaaagtggtgtattcaaacacggatttggtctagttatgacgtagcttagctcatgttgctcataaatatgtgtaaactgttcattatctcatgccttcctaaatccctggcttgttagaataatctagtgagacaagatatacaagaattttgtaaaatgtaaaattcaccagtattaggcttgttagagcaaaaaaaaaatttcttggtttgtagattcagtggaaagattattgtaggttttaataagataacattcagtgtgaaaattacaaatgagaagaaatgtaaaatttttgtcatctgtttgcatgtgatttcagtttttccatgtaaataaacatgtacggcttgcccaagttcacacgactaattacgtatagaactgggatctgactttcttcacaccaattcatcaggtcactttttcctaccataaaaatcttacctggttgataatacaaaacactgctatttttcttgcttcatctaggctcaagtttcttagtaccaggtaccaaaataccagattaacgaggtcatccaaaaaatggtctttatggcaaaaccatatgtaagccttcaaaattccaaaatgtattttaaacactacttactgaatcatctcgcaattaacacgtaccattctgtttgcagttcatagcactttattttccctgaatgctttacagaactttatagagctttataaaacttccatcttcttgagtgcagtattcttagggaccagtgatatttgttactgggtgaaattcaattgtctccattttatttgatgttgctaagataacctcacactcaaaatcacatgaatcttcttattttgaatattattcagaggaaaacttggtttttttgttttttggcaatgtgtttttttaaaaaataaaaatagcaaaattctattttggactatccctccagtggttattttcttagtttcaattgactgtttgcagtatgctttctctatcacttcccaacttttatctgtaagattaaaatggttgctgtcactttaaaagtgaatgcaccactagggaatacaaaactttttctttaactattaaactatgcaatccataataccattaaataatttaattaggttgaaaatgatcatgcataaatatattataatgattttataacatagtcatattttacatttatgaaaagtatatattgagataactagaaatatgcaaatagacataaatatatatttatgtctagtaaatataaaataagaccacatgtaccatatgtaccacatcatacatcaaaaaatttgatatgataaatatcaaaataatgaatctaaaactatttcctagaaaaatgtaataagtaaaatgcccttataaatatatttttgaggcaaaaatctaaaatcatattttagttaaaaaaatacacacacacacatacaaattatctatgcccacagttcactcattctattattgtttaatttttttcagtgatctctcagaggcctttatagattctgaatacaagtcttttgtattgggaatattatccagctttgtggcttgcattttcaccctcttaatgctacgtttgatcaacagttctcaatttgatgagctccaatttatcaatcttattttgattgagcttttggcaccttaagaaatattttcctctcctaccttatgtatttgactacaatggtactgtccactagtcatgcgagattacagagtacttgaaacacggctagtccaaagtgagatgcaagctaagtgcaaaatacacactgaatttagaagactcagtatgaaataagaatgtgaaatatctcaaataattttatattcatgaaatgtgtttacattgcttaccttttcattcattttgtccctcttttctatgcttttatttaccatattaatcatcgttattttaaattctttggctaactctaatatcagtttcatttgtgggcatccaaggtttgtgttatttcttttctctttttttctttttcttttttttttttgagacagggtttcgctcttgttgcccaggctggagtgcaatggtgccatctctgctcactgcaacctctgcctcccaggttcaagtgattctcctgcctcagcctccagagtagctggcattacaggcatgtgccaatacacccggctaattttgtatttttagtaaagatggggttttgccatgttggtcaggctggtctagaactcctgagctcaggtgatctgcctgcctcagcctcccaaagtgccgggattacaggcatgagccaccaagcccagcctgtgttatttcttgatactcacatttacatctctcttttcatgtataaaaattaaatgccatgtattatatataaatgaatcagagatttatgttaccttccaccaactagtagttcaactctcctctattaagcagagaggagagggggtggtcactttaatccattaaaggattgagctgggttggggtgggctgtcattttagtaagacttagtccaacactggtatgtctctgttcctcaggtgtggtggtgcttttgtttgtgaacctggcatgtctctatcttctcagttctaaaatgacaagattgcctttagagattggagcttagccctttatctcctactctatgtgggcgtcaaaatatgcaaacttttcgtttaaggaaagtctcaccctctataggaactttgtttcctaagtattaagacacaacagcagattttactctgcttttctgtgccccagctacccaaaactcagaaaacatcttgcagagataactggtcctatgtttggttctcctttagtttctcattcatcaagccagcctcttgctggtttctctattccatgataaatcctcttcatggaccaagactatacttactgaaaattcagaaacagcagattcccacaagtaaaaatagttggttattgttagttttcatatgaaagtcttctctcattggaagttgtggtaggtagaattttaagatggcctccaagctttcctacccctggtacacatgtcttgcctatctctgggcccttaattatgtaggattttactcctgggactaggttgatatggtttggctctacgttcccacccaaatctcatcccaaattgtaatcctcatgtatgaggggaggggcctggtgagaggtgatggaatcatgggggcggacttcccccttgctattgtcacaatagtgagtgagttctcatgaaatctggttgtttgaaagtgtgtgccacttccccttcactctttctcctgcaatgtaaaacgtgccttgcttctcctttgccttttgccatgatagtaagtttcctaaggcctcccagctatgcagaactgtgagtcaattaatcttttttttatataaattactctaagttagttcttcatagcagtgtgaaaacgaactgatacataggttatgttatatcgcatggttaactttgagaaagggagactacccaggtgggccttatgtaatcgcatgagtcctttaaaagcacagttttccctggctggctgcagaagggaaagtcagagacaagtacttggccacacctggaaaacaggaaaaacccatgttgtaaacagccaacagacaggtatgcctcaaggaggtgaaagtggtttccagccaacagctacagaaaaactaggacctgcattctacaaacacaagaaaattaattctcagaacagccaatgagactgttaaagtattccaagccccacataagaagtacagccccagttgacaatctgattttagtcttgtaagaccccaagcaaagaagtttgccatgctgggcacagacttctgaactataaaactatgacttattaatgggtgttgtttcacaccactaaggagaagatagtaatttgttacacagcaatagtaaactatttttacttatttagtaaactacttttactttatttaatcttccttaattattcagttccttaataccttataaatatataaatacatataataatttatatatttagtgtacctgatttttctgtagctacttacattttatgcaatagaagtctgcttgattttaaagtatataaatatgaagttgaagataatcactcacttatacacaattcaccaaatatctcacttctaaactacagaaagaaaaactatgcaaaatgcttagcatatttcttataggttttttccacacatataaatatagattggtaaatggataaatgatgaaaaattgatggacaggaaatttaacagaaaagaaaaattggggaaatgatcatataggttaactaatggatttaaattacaaattaatagatactttttatctattaggatacaaagcaaatgatgaactactgtcctaagccaaccgcatcaaggtatgtatatgtgttatatgggaatttaaagtcatggatagaaatatttgcctgtttgagtaaatataaagctactatatataatttttttggaatagatatttaacagatataaaattaggtttccgaggttcatctgtgattatataaatagcagtactctcacgaaactgaacctcctggcttcttaccattaataccacgttgatgcaaaatagataccaaataacagtaaaagtcattcccacagtatattgctctgtcaagaaaatttcgactgcttacatgaaaatgacataaaatcttttaccaattgattttttaaagttgtacttcaatgaatagttgtcacgactatattaaaaatacctatgactgttctatattattcactgcatgaacctgagattttgttctgtttttgacaatgctaaaaatgacatacctacctctgttagggaagggggcaaatattaactatttttaaagagaattattttgtgtaaacaactcttagatttatcaagctcagaaaagtagtccatcagccaacagtatctgttgagttcttactgtgtggtgagcagttgctagtgctggggattctgaaattgatatgcattcatacagtccttatcccagaggtttcagtatgtggttggtaaccggcaacaagttattacaaatggcatacacaggtaaaggaaattcaagatgtaatgaagacctataacaaagtaacataactgagtctgagggttcaagccagactttcctgagaaagaaaagcttaatctgaaatttaaaggataaaatggtattatccatgcaaagaggggtggtacaatcatgccaggcagagggagtagcaaaataaactcttggtgatcttgatgtagggaatgagggtgacaccctcaaagaactgtgagaagttcagtgttgagagtaagcagggcccaagtcttgcagagtcttgtcatcccgtaagtaccatatcatgtactcccccatccagtgctactcaaagtttggtcacagaacagcactggatcctgaaatattgataaccaatataaaatgaaataagttcagtcatgtggatgaaggctttagaatctcttatagcaattcgacccactaattttatgtccattgaatttaatgacaatgagaattcgtattttgcatatctttgtttttctctaacattttctacagtaatttttctgtatttatcaaattatctgtcaacaatgcatgattttttaaaatgatcttgtatcataatcatttgaaaaacattaccctaaagtaccctgattcattctaggtgacgttgacactggaaataagctggacagacaaatcataggttgataatggttagtgggaatgaaaattcttctctataaggtgctctgaaatgtataagacactttccagtttataaaatgcaaatgtatttttgatcctcacacaaactttgtgaggttgctacattcatatgtgatcaaaggtcacctagcgaataaatgacaaattctaccatcttggcttgctgatgaccaaccttagggactcatgtagaagacctgtgtagtctgctcatgctcacatgcttttcatttccattcatctaaactcttcgagacatgctaacgagctgaaattatgtgactttggatgcatctttcctttttcaagttgtgcattgtcagggtactaaagatctcaaatgtgctatggggcttcaccccaggaaagggagaagcagaaaactaaataatcagcacccagatagaattgacaacacaaatttgtcttctcctccctctggggaaaaaatcctgcagtctttgatttgtaaacaaagccatgtccttgatcaaaaaccgaaagatctaattgttagctattttaatatagcacaccaattatatttcatttctccaagaatgtgaaattgtgggatttttattcatcttcatctgtacagaagccctgatgtaaatcttttacacattgcttaacaaccacagaaatatactttgtatgggcaatccctacaacacttgaacttcatcccacagttaatactgcatctccctggcatattgtttacaagaatgaaagaaaacaagccaatttagtaacagaaacattataatccatggaaataagaaaaatgagtggaataggatcctcttgagacttcagtgtaattaaccaatgtttaagatgtataaatgctagtaaacttagaatccaagcccaataatttctccagttagaagtgcctgcttctgaagaaactacacaacacctagatcttaatgcagttgctaagaagtcattcaatagagtcggtagagatgggttcatctcctggatctaccacttgttagacattcgatcttgggaaaattagtatgtttctctaaaacaggaataataacagcatcaatctgatatataaatgaggtcatgcatataaggcatttattctacctaatctaacaaagtataaccacattgctgctgtggttattagtatctattacttcagtaacttatcacatatttttgtgataaagacatgtttttaatattattatctctccaaaatcaagatacttcttatagccaatggcacagcatagttttttctggaaactttttctattttaatattacataaaatgacatattacaacccatggtgttaatattatcatttcttagaaaccacattaaactcattttaggctacaaggagacttaattagaaccattatgcagaatattattaataaaacttcagttatttaaaactttcatgcaatgtttcttagaattcacagcttgactttattttttccaggagaaaatagaaatatttcttttttttttttttttttttttttgagatggagtctcgctgtgtcacccaggctggagtgcagtgacttgatcttggctcactgcaacctccgcctcctggattcaagcatttctcctgcctcagcctcccaagtagctgggactaaaggtgcccaccactacacctggctaatttttgtattttttagtagagatggggtttcaccatattggctagactggtctcaaactccagaccttgtgatccacccacctcggcctcccaaagtgctgggattacaggtgtaagccaccatgcctggctatttttttttttttttttttactttaagttctgggatacatgtgcagagaatgcaggtttgttacataggtatacatgtgccatagtggtttactgcacccacccacccctcatctaggttttaagccctgcatgcattaggtatttgtcctaatgtactccctccccttgctcccacccccgacaggcctccgtgtatgatgtttccctccctgtgtccatgtgttcccattgttcaattcccacttatgagtgagaactaacacagcttaactttcatgtgcaacttctactctgtatcagggagacaaaggtttattttcttatcatgaattaaacagagtttggcaagtatttaatgagttgtgttgctggatgctataagaactacaaaacataggacagactttccacccttaatgaacttcttaaaggaggcatatgtctacatgtaacatataaaatagtttcatacttacaataggcactgaatcaagatttgccaaaattaaccaaagatagtaaatgaaattacatatatagatagactactttggaaaaatttaaacacaggctctctgtgctctacagggtcacagaattttaaagcttgaagagatattagaaatcagccactttgtgaaggcaagtcataagtcatctggtctagctgccacactttaagacagggatcctgagctcaagataatttactgagattcacaatgtcctctgactgggaactgacagatccagagagcaaaatccatcttctgtctcaggatccagaataaatacgtaatttcctgagtagctgagcagagcacggtggatattagtgtcatatgtatattaggtgccatgctagaggaggtagaaggaaaggtagtctttacctgtgtggccatgtctaactaaaattaaagggaggtcagttgctgtggcttacaactctaatcccagtgctttgggaggctgaggtgagatcacttgaggctaagagttcaagaccaaccttggcaacacagcaagactccatctctggaaaaaaaatcttagctaggtatggtggcacatgcctgtaatcccagctacttgagaggctgaggcaggagaatccattgaccccaggagtttgaggctgcagtgagctatgatcacactactgtactccagcctggatgacagagtgagatcctaaaataatttttttcaatttattaaattaaaggaagtttcattaccacatggaaaaataagaagaaaatagtcaatggagaaaaattaggagttggccacagaattctggctgaaagtaaaacacgagcgaatgtcattaggtgaaagcatttgggaatgctgattttgtatgatttacaatagccaagacttggaaccaacccaaatgcccatcgatgatagactggataaagaaaatgtggaacatatacaacatggaatactatgcagccataaaaaagaatgagtccatgtcctttgcagggacatgggtgaagctggaaaccatcatcctcagcaaagtaacacaggaacagaaaaccaaacaccgcatgttctcactcataagtaggagttaaacaatgagaacacatggacacagggaggggaacatcacatactggggtctgtcaggggctggggggaaaggagagggagagcattaggacaaatacctaatccatgcagagcttaaaacctagatgatgggttgacaggtacagcaaaccaccacggcacatctatacctatgtagcaaacctgcaggttcagcacatgtatcctagaacttaaagtaaaattttttttaaatgcagattttatatgcaaaaaattcctgaatattgatgatttcatatagtgaaacctaatacattgttgcacacagaaaagagtcaagaaaacaaactggttttgttagcacctcattcctcatctgaccctgtttaccttttagttttgtttggggtctctgtagccagggcagttagggacagaaccttaaggaggtgtctccatgaattactatgtaaattacatagaggagtaaagcccagactgtcagcccaaaataacaatgtgagttacagagtatctgcatggaacccaacaacagaaggacactcttggcatagacttaaaggtcaactggcagcaccaagtggccttgaacatgaagtatttttaaataggaaacagaaacagtagatcagtcaaaataaatactaggagttcccaatatacttactggggacgtgcaagaggtggagtgtccttcaagaatatgagggagcaggagacattgcattgggaatattattgtcatcactaacatatccttgcctacgatattggaatatattcagattctgtcagtcttacctccctttctctgtctttctccctctcacacacatgcacgtgcgtgcacacacacacacaatcctacccatacactatattgccaatggttctttttcaatggtggcaatataggtttcagacttttgcttgtcagtctgttctgtattttatatagtaacacatgctacttttaattttaaactatacaaatcaagaggttttaaagagttttatccacgattaccgcatattttatgctaatttttaaaatacaaaagtaatatgttaaagactaccttaacatcagaatttctctttagatatgaatgccactgtatcctgataatactaaacacagtgaggatattacacctgcctagtacatttatgattttattgctgatattcattctccatgctaatctgcaggaagcattattactgctgtattttataaataatgctcttatttgtggtaatgcttagcagaaatgtaagaacttgcaaaatattttagattttaaatttgtcttcttcttaaatgctgcttttggtgctttataaaggtcacaactacattttaatgttcactacatgtaaatatgggaaagtgcgagaaagccaattagatgtgttctgttttatttacagagtgcttgcagctctagtttgctcactatatcaacaccttgtcagataaattatgaaagtttattcattcattcaacaaatatatatagtgaacacctactatgagcaaacaataatggcctttactggaaacaaaatttacatttaaaggtaattctagctgcacagaacaataagaagccatataatgtgctagttaagggcacagaactcaagtaagtttacctagttccaaatattagtttcatcatttataggtgatttgtgaacttagaagaattacataatctctgtctcaggtagttatcagtaaaatgaggataatattatctacatggttggggtgttatttgcaatgaatgagatcaattatgtgtcacatatagaaaatgctatgttttcagtgtttggtttccctgatacactcaaatttttgttgaaattatcagtagacctactgttttctccagaagaaatattggtgattggataaatgaatttagaaagtcatgacatttcagagctggaagaggatttattgattacctaacaaccccatcattgtacaagtaagaccacaaaaacacagagatacaaagtcaagtagttggtaagtttccaagcttgattaaatcccacttttagggctgcgtgcagtggttcacgcctgtaatcccagcactttgggaggccgaggcgggtggaccacttgaggccaggagttcgagaccagcctggccaacatggtgaaaccctgtctctactaaaaatacaagaattagccaggtgtggtggtgcacacttgtaatcccagttacttggaaagctgagatgggagaatcacttgaacccaagaggcagaggttgcagcgagccaagatcatgccactgcactccagcctgggtgaccaagagatacctcatctcaaaaaaaaaaaaaaaaaatcccacttttatgacttcctgaccagcattcttagaatagatgccaattgcatgtccactcattcattctacaaatatttattaaacagcacttcccatggcaagcactattgctaaatacaaatgacacttggacaaatcagatgggttacttatcctctaaaggttcacattatattggggtgcacatgtaaatgcatagtgttatgtgtgctctgataaaatatgaattggtggtagtacaatgtgggagtgatagtacaatgaagtcagtgaacaaatctatctaaaaattgtagaaaggcttacacgagatataactcttgatcatgaatgtggactaagtatttagacagaggtctatgtgtctgaagtattaaacaggaagggggaaggattcattaaaagaaaaatataaaagacagtgagtgaccaaatggtgaaaggctttgtatgctgatatggtttggctgcgtctccaccctaatctcaccttgaattgtaataatctccacgtgtcaagggcgggaccaggtggatatgattgaatcatgggggcactttcccccatactgttctagtggtagtgaataagtctcatgagagctgatggttttataaatgggaattcccccacacaagctctcacttgcctgcagctatgtaagctgtgcctttgctcctcctttgccttccaccatgattgtgaggcctccccagccatgtggaattgtgagttcattaaaccctcattttctttataaattacccagtctcgggtatgtttttcttcacagcttaagaacagactactacatatgccctgatatatagttttgtattttacttctaaactattcacaaggaaataaattaaatggaaaagaaatgattatccaaagatatcatagaagaagcaatgtcatgaagagtgaagttcagattaaaaagatttgctatacccaaagcaaaatgagtgaacaaagatggaaatcagaaacaaccttcataatattattttgtttcatgcacttaaaaactgtcctccataagcatgggcaaaggtttcatgacaaagatgccaaaagcaattgcaacaaaagcaaaaatgggcaaatggggtctaactaaactaaagagcttctgcacagcaaaagaaactatcaacagagtaaaatgacaacctacagactggtagaaaaaaatgtgcaaactatgtgtctgacaaaggtctaatatccagcatctataaggaccttagacaaatttacaagaaaaaaaacaaccccattaaaaagtgggcaaaggatacgaacagacacttcttgaaagaagacatacacatggccaacaaacatatgaaaaaagctcaacatcactcatcattagagaaatgaaaatcagaaccacgatgagatactattttacaccagtcagaatgactattattataaagtcaaaaaataaaatatgctggagaggttgtggagaaaaagaaatgcttttacactgttggtgggagtgtaaattagttcaaccattgtggaagacagtgtggtgattcctcaaagacctagagacagaagtaccattcaacccagcaatcccattactggatatatacccaaaggaatataaatcattctattataaagacacatgcaagtgtatattcactgcagcactattcacaataacaaagacatgcaattaacctaaatgcccatcactgacagactggttaaacaaaatatggcacatacaaaccatagaatactatgcagccataaaaaagaatgagatcatgtcctttgtagggacatggatggagctggaggccattatccttagcaaaccaatgcaggaacagaaaactaaataccatgtgttctcacttctaagtgggagctacagcatgagaacacatggacacacagaggggaacaacacccactggggccaattggagggtggagggtgggaggacggagaggatcaggaaagataattaacggatgctagacttaatacctgggagatgaaataatctgtacagcgaaccaccatgacaaacgtttacctaagtaacaaacctgcacatcctgcacatgtaccactgaacttaaaagttagaaaattttaaaggtatcctaaaggcatcaagtatggcagaaaaaaaattaagtttataaaaataagaaaataagaatgggttatcattatccaatgcctctctacaaattaaggggctaggtctgcagagtgttatgggtgaaaggttgttgtaattgacaaattctgtacttaaagatattatccataaaatttgaaggcaaaacaaaaacatatctgaaatgtacaaaagttcaggaaataaactagataacattcctgaaaaaaaatcactcaagggcaaatttcaagtaatctaaaaaaattcaaaataaagaccacacaaataaagatgtagcagcaaaatataaaagattaaagaagttattaaagcaagttaaagagaaaattacaggtaagtgacttctgtaaatatggatataaaatagctcttgtcttaaggaaattataaaatatcatatttgcatataataagataaatcaaatacatatataaagtggaccccgcatcataccaaagggaggagggaaatcattctgatgatgatggagatatataattagtagaattaaaaacaggctttgtgctgttaaaggatggcaagaccaaccactgaatagacaagattttctaaagctgaatttattgcttattatcataaagaagaacactgacagtcaaacacagtctttccaagcagaaaaaacttcaagtcatacatagggtttttggaaagcatgatattccgagattggtaggttttcagaggtataaggagttgacgtcatcagtaaaagtatggtaacttgggtgagaatgcctttgattgcttggcaccccaaaggcgtatatattggagtgaatctgtttctgagtggctaacttttggtagcaagagtctgtcactgatagtttgtcattgatgggctataaatgttatcgatcaactgaactgctttaaaactgattttgccgaagcgggcggatcacctgaggtcgggagttcaagaccagcctggccaacattgtgaacccgtctctactaaaaatacaaaaaattagccaagcacggtggtgcatgcctataattccagctactcgggaggctgaggcaggaaaaccgttcgaccccgggaggcagaggttgcagtgagctgagatcatggcactgaactccagcctgggcaacagagtgagactctgtctcaaaaaatggtaataaattaaattaaattaaaattaaactgattttgatgctccctgtagcatgactaccaaagattccatctttgcctaaagtatgtgggaactttccattttcaataactaccaagttaccaaagggggaaaaaaacaaattaaattgaaaatctataaaatgttaagaaactgtatgaacagaaaaaataagatgacagttcaaatatttttgttactttcattggtaatgttataaacattcttattaaaagaaaattattctgatcagcaggggaactccagttctcgaaatggcagaaaagattgtgctggattaattctgcgaccattaacatgtataatttccccacaagatattaaaataaactgcctaaagctattgacaagccaacaaaaacaggcaaaactgtaggggacacagttcttgaaagaatgcctcctttaaacagctttacagtgaaagagatttcctagtttcctgcaacagaatgagattagagtccaaacagaaagcagctttactgagctgaagagacagaaagagtttagggtaaccctggaaatcagagaaagctcctgaaaagaagggcacacataggaataaccttaaattctgcatataagtccctcaagtgcttggacaacattaaataacatgtattcagaggaaaaattcaagaaacctagaaggaagcagtaggcagttaggaggcagagatttcagcagtcgcctgatgctaagaagacagttgatatgtcaagttctgtcaagctagtatagcttggtgaacacactgggctttcccctaacatcgcagcagggccttgtcttacaaatgagcccaggactaagaactatacaaccttatggttaagaataaaactaaaatataaccatcataaataagcctagaaccaagtctctgtagagtcaaagtaatctgttggtgatttaattgcctgcctgcaaaaataaaacttgtgtcttttaggcaggtaagatccagaggctcctcaatgccctatatgcaataaaaattactacacatacgaagcgtgagaaaaatatggcctataatctgaagaaaaatgtagccagtagaagcagatcaacagatatccctgatgtagagtgcttattataaataggtttaattttttacaagagagtaggacaaaatttataaaacaataagaaacattagagaaatgatgctatcaaaagtcagataatattccagatttaaaataaaatttaaaaaaattattagatggacttggtccacataaaaaagaaagaattagtaaactttaagacaagttattagaaattaaacccagaaagattgaaagaaaatcaacgggacctgtgaaatgtaaaataatatcaaacaacctaacatgtgtgattggagtagcggaagaagagaaaagaaaaatgacacagaaaaacatatttgaagacataatggctgcatattacccaaatacagtgaaaaacacaaatttaaagattcaagaaattaagcaaatcccgagtatggaaaatagaaaggaaaacaaatgaaagctcatcaaaagtgaaaatgctgaacaccaatgttaaggagaaaaatgttaaaagcagccagcaataaaagaaatattacatattattctgttccttttggaacatggttaaaaataatggttgtcttttcatcagaaacaaaagagtcagaaagacaatacaataagatctttaaatggctgacagaaattttaaaatgtcaacctacagctctgtatgtagcaaaaaaataaccttcaacaaaaggtgaaatggatatattgtaagataaataaaacctaggagaattttcaccaacataaaagaaacactaagaaaaatttaagctgaaaaaatgataccagattaaaaaatcatgtctataggaagaagtgaatagcaccagaaatacatatatgtagaaatttaaatgacttatttcttattttgacattatatatatacatatatatacacatacatatacatatatatacacatatacatatacacatatatacatatatacacatatatacatatatacacatatacacatatatacacatatacacatatatacatatttacatatatacacatatacatatatacacatatatataatatgagattctgggattttgtaacatgtagaagtaatatatatgacaataatagcacaaaggaagaaggagcaataaagagaataatcatataaaatcattcaattgtgtatgaagtcatataatgctaattcatggtagcctttcataagctaagccatatcccccaaaataacatgcaaagttaaaaagccacttaaggctgggtgtggtggctcatacctgtaatcccagcattttgggaggccaaggtgggtggatcacttgaggtaaggagtttgaggccaacctggccaatatggcgaaaccccgtctctactaaaaatacaaaaattagctgggcatggtggtgcatgcctgtaatcccagctactcaggagtctgaggcgggagaatcacttgaacctgggaggcagaggttgcagtgagccaagatcacaccactgcactcttgcctgggctacagagtgagattcaaaaaaataaaatataatcataaaagtgctccatatatccaaaggcaggaaataacaaagaaaaaagggacaaatagaaaaacgttctattcttcaaaattgcacttaatataactggacaaaacattcttatcaaaacacagaaattgtcacactgggtagaaatagcaggatctatccacaagctatttacaagatatgcaatttaaatatatagaggcaaaaatgttggaagtaaaacaacggaagagtatataccatgaaaacactaagaaaacagtatgagcatagtttggtggctcactcctgtaatctcagtgctttgggaggctgcactgagaggattggttgaggcttgtagttcaagaccaacctgggcaacatagtaagacccattctttacaaaaaatacaaaaagttagccatgcattgtggcacatgcctctagtcccagctacttgcgaggctgaggcaggaagattatttgagcccagaagttcaagtttccagtgagttatgactgggccactacactctagcctagttgacgaagcaagaccctgcctcttcaggaaaaaaaaaaaaaaaaaaaagaaaaagaaataaataaatatggtatggttttattcatacaagaaaatgtcaactttaggacaagaaattttttgagaaaaagaaaatattttcataatgataaatggttaaatttagtaagaaggcctaacaatgtgaaatgcacatgcaattcaaaacggaaattctaaaggtgttacgcaaactggcagaactagagggaaacataatgaacaaatccataattacacatagggattttcacactcctattttttactgataaaacaagaagacatgaacataagaaagaatagaaaacatttaaacaatattttcaaccagtgaccaaattggtatttatattactcatagacaaggaatgacatttgaaggtcttgggtgtgagactttacaaggtctataatgaagatagggtaataaaaatacagtgagtagaactgaaaagttacggaagtgtgaatatgatggcatgttcagagaacctcaaatgtacagttaataattctagagataaatctggaaaagttggtaaagatgcccatggaatttggcactaaagaacttttggcaatttttaaggaaggggaggatcatgatcagatcctttttaggaaagtatagaggaaggaaatatgggactatttaaaaaaaataaacataatacatgggccaaatatggaccatttataaagatgtgaaaagaccagagatagagccattaaacaaatgtcaatacatttcaaatgatgaaatcatacagtctgttctctaatgacaacacaaataaattaaataatgaagatatatatagtctaaatatttggaatttaatttccaaattaaattaaatatttcaattcttctaaatatccattagaccaaatattacaaggaaaattaaacttttaaaaaagatatataaataaactaataagctactcagtatcacatgtcttaatgtatcacttaatagaaactggattctcatattgtttcttcattcagttcattgtgacaagttgtgttggttgagacagctgaataaaacagcctcatacagatatatagctggaaaaggaaggtgttcttttgaaaaccctttcagctaatgtagatattgttcttttatatcaaaactcaaaaactgatgaaacctgagaagttagttacaatacagattatgaaactgttagcaaaacaccagggtttaattctaagttatgctgctcactgtacagaatgccaatcactgagacaacacatgctgccaccaaggagaatggtaggtcagcctcaggctcatctccctgactgaataaaactagggcacttatacagggaggaaggtgggaaaacaggaactaaggaagggtaagaaagcaatcatgatggatgaaggatctagaccctcattgtctggatgcagggatctagtgagttttaatctcttgcctgagggttggtttcctgaggaaggaacacagataagacaaatgtaagtttcaaattttaaaaccaaaggtcaatttctatgtttattcaaaaaacctgcaaaaatcagttttatgggctaattatgccacattcaaaatcatactgcagcacactgaatgttggcctccaataatatatatgcataccttgatccctggaacttgtgaatattactttacatacccaaagatatgattatgttaaagattttgagaggaggagcttaccctggatcatccaagaggaccctaaatgcaactgcatatatctttataagacagaaatggagaaagttttcagacagaaagaaggaggcaatgtggccacgggggcagagattggagtgatgtggtcaccaatgaacgaattgctggaaccaccagatgctgggaaaataagtttctttcctaaagtcttcagggggagcaagggcctgctgaccccttagtttcaaatatcaggcctccagaaataacagagaatacatttgttattcccagtcaccaagtttatggtaatttgtagcagcagcactcagaaacaaagagacatatcaataaacttttcacattctgttacattaaaatccattggtctatcttgaactttgaatagatctttcactcaagcgtgattttgtaacatcattcattgtttatgtgcaaaacattggttaactaagttattcagatgttccaatgttgacacatttcattgtgtaatatcaaaagccacatatattatcaacaccaatcttatcaaacacatctttaaatattgagaagctggtggttacaagatttttaaaattcaaatatttgcctgaaggttcaccttttatccctggtaaaacatactgtcaagttgttttccttgaagtgacagacacacttgatttttgaaaagtgtctaaaaaaaacccaatctgaataaccatagacagtcatttttattaagtaaaaaatgttgttccatggaaaatgcagccaacttcacttacaatttaagtattctatttgtcaggatagccactgaacttcagaatgcacctgtagtgatttatgtggactgcccattttttcacaaagaatattaaaaatgagtgtactcaagggtcaaaatttagtacaattagcaatttttactgtttcatcaaggacatttttatatgatgctgttatgtttactgtttcttccttttgtttttgactgtgagtacacagcagagaaaaaaacaataactattagtgcagtttgttgccactgttttgattatgccaaaatgccagctgatttatttttcccaccattgcttttgttgcatccgtgcaaatgttcacatgaaggaaaagacaaataacaccttagcattattataaaaatatttctggtctttttgaccccccaaagggtttcaggagctccccccacctcccaggagtacatgtgttccacttcgatactgatgtaaagcaaattgttccattgcaaatgggatttaagatggtagaaccactttggaaaattatgcggctttgctttttttttttttttttttttttgagatggagtctcactctgtcaccatggctggagtgcagtggtgcaatctcggctcactgcaagctccgcctcccaggttcatgccattctcctgactcagcctccagagtagctgggactacaggtgcctgccaccatgcccggcttttttttttttttttttttttgtatttttagtagagacgggctttcgccattgtagccaggatggttttgatctcctgactttgtgatctgcccacatcggcctcccaaagtgctgagattacaggcgtgaaccaccacacccagcctatgtggtattttgataaactttaactacctacctaccttaggactcagcaaatctactctgactaatatatcaagagaaatgagggaatatgtccataaaagatttgtccacagatattcataatagcttcttatccattataactgaaaattagaagcaaataatgtccagcatcaagtaaacacgttaaaattacgttatatctgtacaatacaatccttctcaaaaatcaatacagtgaattactgataaaagcaacaaaataagtgaatcttcaaaacgttaatttgagggaaataagtcaggctacaaatagatatgttaggtatggttatgtttatgtaaaggtcaaggacaggaagacttgacctgtggttatgaaatgagaagagaggttcttctaggaagtgtgttgactgggaaaggacatgagccaaaagtttctgtggtaaaagaaatgttctctagcttgacgggcatattgattatacaccaaactcaccaaacagtactcttaagaagcatgtatttcactgtacgtaagtcatacttcaatacagttcttaatttcaacaattacttttattatttatttttatagtctggaataaataaataagtacacacacacacacacacacacacacacacactatatgtacaaattacatgctatcaacaagatacatggaacaaagtggcctggagagactagaaggaaaaagatgggcaaacagagcaataaaaatacaataaaaataaagcaaagattctaataataatatcaaaggagagttcaagataagcttttcagtagataaagttgctctctgtggtgaaacatgcaactaacaacaaaccaaactgtggtgagatttttaggcacttgataacctaatatgtaaatatataaattaaacatttagacataaagtcagaaataatttcctaaaagtttttaacacaatctttcagcctttgacaaatgaaataaatggaaatagaatatatttgtgcatatatatgtcattcatgtataaatatatataccaaaagcacaacccatagcatatgaaatgtagagatagtagcaaatctttaagcatttaactgtggatttaaatatttttaaatgcatacttagaaatttaaagatagccagaaacataaatttaattgaacattttaaacatagtctttaatacaacgagtaaacaaaaaatgggcctgagtaatgtattaatagggtgtactttatgtgtaactgtatttcaaatcctaaatcctatattaagtattgcaccttctattgaagagccaatggaacatttaaaatgattgctcatatatcaagccataaagaaaacaccaataaattcctaaaagtagaaataaatccatcctcattcgcttcaatttactactataaaacaacaaactaataacaaaagtactatttgttttgttttgtttttgagatggagtgtcaatctgtcgcccaggctggagtgctgtgacacaatctcggctcactgcaacctctgcctcccaggttctagcaattctcctgcctcagtctctcggctatgcaagtagctgggactacaggcgcctgccaccatgcccggctaatttttgtattttttttctatagagatggagtttcaccatattggtcaggctgctcttgaactcctgacctcaggagatccacccacctcggctttccaaagtgctgggatgataggcgtgagccaccgcgctcggccgtaatatcttaactagatttattttaagacatagaccttcaaagcaattttcaaaataaaaaaacatgctattcttgttcatagcagttactgcacaacacaaaacatgaattttgaaaaacatatctaagaaacaaaaaggattcaattcaagaaggaaaaatagacattcatcactgggattaaaattatgtatcttatttcctctaagttgaaactttgctttgtccaaaagttgattgtaccgttagtgaaaacgtattttttacagaccaaagtaacaagggaacttagttaaaatgattagactttgaataacatcaaaaaactacaaataactgtgtaaggagaaggaatttgtgctggtgttttgaatactgggaagtgtaaccttacaactgggcagcttgtagagagagagttagaaaattatcttccaggccgggcgcggtggctcacgcctgtcatcccagcactttgggaggcccaggcgggcggatcacgaggtcaggagatcgagaccaccctggctaacacggtgaaaccccgtctctaccaaaaatacaaaaaattagccaggcgtggtggcggcgcctgcagtcccagctgctcgggaggctgaggcgggagaatggcgggaacccggggggcggagtttgcagtgagccaagatggcgccaccgcactccagcctgggtgacagagtgagactccatctcaaaaaagaaaagaaaagaaaaagaagaagaaaattctcttccaaccctattccccccaccccaccctcctccccactcctcatgtataatatatcagggagccagactgggaagcgggaggaggaaatctcatctcagtctaatttagaggcatttgaatgatttgaagctccgctttagacgtctatcagcaaatgacaggctcccttgcccttccattgtttgtggatgagtccgcagtaaaaaaggctgacatggtatctatgaaaacaaaatactgcagtatacaaaaacagaagcttgacctcaaaactcacagaaagaaagccccctgataatgatttaccaaaggaacagaagtagtattagacaaaaatggcatcttcttttggctctaggtagagtctgtttgcattctatgaaaaaaaaaatagcagaaaggattttcagaaaacagaatgagatgaaatgttaaatgataggggaaagttttcagggaaagagtctacacaatagtagaatctgaattggaagctgaacaaaatgaaattaacattgtggaaaataaaattagcaatttggaaaatcctcttgaaaaggtcaccacatatttagataaagagatttaaaacaaatactcattaaaaataaaagagaaagattctaagcacagattgtaaaccaaaaggtatctgagacaggtctcaatcaatttagaaagtttattttaccaaggtcaaggacatgcccatggacctcaggaggtcctggcaacatgcacctcttaaaagtataaaagtataaaagatatacctggtctcaaggaggatgaaaaagaagaacatttgaaaaaattattaaatgataattgataaatgataccaatcaagaaaacctgcatgtcctaaggccctaaatcacagataaagatgaatccaaaaatccccccaataagcagcagcaaaatgtttgaattgtatttttaccttggtttttaaactttgcatttaaaaaaaaatttaaacttaaaattcacaagaaaacaattaattgccatatacacctctcagcaattgttaccttttacaatattactatatgctgtgttctctctttcttcctccaaaaataaggttattcattttcttacataaccaaagtgaaatgatcaaattcagaaaatttaacattgataatactaattatgaaatttttatttaatttcaccaactgtccttaataggatttctttgacccatttgtgacctaatctaggatcatgcatggtatttcgttgtcatggttctttaggctttaatccggaatagcttctcactcttttttgaaaaattccatagcacagacatttgaagagtacaggtccatcgttttgtaaaatgttcctcaatttgactttgtctggtggtttcgtcatgatcagtgtcaggctatgcacttttgacaggaatactgtaaatgatgtatgttcttctcagtgtgtcacatcaagaagaaaatattatcaatttttcccattactactaatgttaactttgatctttcggttagatccaaggtagagtctgccagatttctcagctgtaaagttaccattttgcctttgtgatttataagtaatctgtgcacagatatttcagacagtatacatacattcttttttatttgaattcattaaaattcactcactggtttgggcatctattggtaagtgttttctgcaataattgttactatgatggctgccaaatagtgattcacaattttatcattgcttctacatttactggttgtcactctactgtaggaaataggtcctccacacctccatttactttgtttacttatttatgtatttattgatcagcagtttcacagatcattttaatttaaagatgatcatccattattcttattttgatgttcacattgtcctagcttaggccagtgggagccctttcaggctacctctttgctctttcactacttgcattttaaaagttttatgcataccttcctgccaaagttgtgacatttttaatatgaagaagtttttaattttgagaaaatctaattcattttttttgtggttttaatttctgtgtcctgagacacatttgcctacacacaagtcacaaagattttctcctatattttttatctaaaagctttatagttttgtttttatatttcagtctataatacatctcaaattaatttttgtgttttgtgtgaagtagggtctaggtatattgctttcccaaaggacagctagttttcctaacacgatttgttaagattattcattttcctaatgaatttttgaccaaacaaatcaaatggacatctaagtgtgtctctagtttttagccctttattctattactttaatctatttattggttctgtgccagtaaaataataatttgattacagcatattatagttaatcttgaggttatgtagtgtatgtctcccaagtttgttcatctttctcaagtttgctttggatagtctaggtccttaatatttctgtatgaattttaaaagcagggttgttggattttgatagaaattacatggaacctatagatcaatttgaggtaaaattgacatcttaacatttagtcttctatcaacatggcatatttctctatttcttcaagtcttcttaattcctttcagtaggtaactaaactggacactatacatctttggttaaacatgttcccctataggtggtatcaaaaatgtcacttcatatctttcacccttagctgagctgctagcagtgtactctatacactcacggttcatggtgtagccttgagatatggggagagttaatacaccgatttaggggctctccctttccctctcctttccaggactacccttagtcttctgagaggaagtgtttgcttcaagttctaacctccagttcttgccaaaaaaggctgcaggttttctgtgggagttttaattggcagtgtgacactgactatgacctgccctcaaactaaaaattataaactccagaaactcactctgtgctctttcctttttctgcatgtcaattcccctctaaaatctcactgctcttcttcactccccagtgttttcacacagttgtttgtattgtgtctagagttcatgattagcaggaagatttgtcctgctggagctcacttagccctgctgcttgaatttcatttttgaattatgaccctataaacacacagggtggggaatgtaagaggttatctaaccacaaaggaaaacagagtgaggtgtcctcaggctactcttctacaaaacaaatgccagaaaggaaagggatttaactactgaatttttggcgaataatacataaacctaaaaatgtacatgcagtcatgatatcttccctgcatggtggtgaggttaaagggttcttagagatacatggacactgaaacataatgatcactgacacctttagggaaaaaaaaaaaaacactagcattttcctatcaaagtgtgaggcaagggccagcatcatcaacatcagttggaaggttattagagtgcagaatattagcccccactccagacctagtgaatcagaattccaattttaaaaatacttaatgtgtattttaaatttgagaagcacttctttagccatctgagattcagcattctaggatttctaggatgtcaatgccaaatcacacttttaaaatattatcatttctttaacccaatttagaagtcacaacaacataatctaaatgcaaagagcatcacgaagatattccttgatacaaaataattatcacaaaaatagaaaaagatgagactagcactaggaaaaaggatgtacagtcattgaatgtttagtgatgaagtttataataatgatatggtaaaatgtttactatgtcattctgaactgtaatgcaggaaacagaagagtagatgcaataacatctcaatgcccgaataaaaaataatcataaaaaatatcagatgtaaatactgttgacactggatagtgatgtgttccccactcatttacatatactttccaaatatgaatgcattttgaaataaggataaatacattttgagtaaccaaagaaatgttatcaatggagaattgcagagggccatttttgtgaatgtgtttcatcaagccatttacttcatgcagattctatcactctgccttagatgctacttcctttctagcccaaaggcagagtacacaaatggctcaatgtgacacaaaataatcagtgagaactagtgactgaaacattctaggcttttctcaattgctttgtgataaagagtaaattctgtaaccactctgagtgacatttctcatatttgggtaaaaatataaactttgatataaacaacataggcatgttataaaaattaatgagcctaagattcatgaaacccttagagcttgaaaatgggggaaaaactgtatgaacaaacacagcaaaactatggcaaaagtcccagcattgtaggaattttctgtttttaaaattattttctaaagtctcaaaagcaagggtaaatttgtgctgtatcacaaggagcatccaatggaacactccttatccctgggagtttattatctagtaagtattataaggtttgtagtttatgcccaattttctaaccctattttctaaatacacattgttgctaatttttgttgggcccacaaacacaatctaagccttccctctagtcttccagtcccttcttcctgggaatcattgatatcaattatagcctaccccactgccaattacaattattgcttgctgctgtttaagtacaaatgatctaattgtcatcaatttgcagttccaattacctggtcatatcttgccttaaggtacctcatctcactggcaactgtgaagttggcagggaggggaaattttacaggatttttcttaatataaatacaaaaggacaattgactactacttttcatatcactatgacaccctcagttgttcaagagttcctttcaagtcattaaatgttttcacaacataacaaaaaacacatatctttttatcctgagaagctttctggcctgttttatggatattaactgtcttgagaagctttctggtctgttttgtggatattaactgtatatctgtgtattagtctattcttgcattgctataaagaaccacctgagactgggtaatttataaagaagtttaattggcacacagtttcacaggacgtacagaaagcatggctggggagtcctcaggaaacttacaatcattggtggaaggccaaggggaagcaggcacatcctacatggctggagtaggagggaggggataaagtgggaggtgctacacacttttaaacacccagatctcctgagaactcactcactagtatgagaacagcaaggcagaaatcctcccccatgagcccatcacctcccaccacgcctcttctctctgaatattagttaacctctctgcaccacaggttctttatcctttctgttccttccaaatgccaaattattttatgccctaaggcctttcaaggtgctgttctccagataactgtttctccggcattactgagatcacagctcaaatatctccttctcagagagacctctgcccaagaataccctcaaatatagcttctcttctcaccccactccaccctcattatgctatgttctattgctgacttcatcagagttctccctaggaacacaaccaatataaatagaaagagagattgattataaggagttgactcacaataatctacagcatgggccagcagtgtggacacccaggagagccagtagtacagttgatgttcaaaagtaatctgctggagaattctctcttgctcaaggaggctggtctttgcattctattcaggcctccaactgattgctcaaggcccacccacattatgggggcaacatgttttacttttaaaagttctttgatttaaattttaatctcatccaaaaacaccttccaagctgacacacagaaattaaccatcacaactgtcctctttattttcttcagagacacctgaaaatctctaataaggatgagaaacgcattgttatctcaaagactgctatgaatttgtttattttctgcccttcccattcacttttcatataagcaccatgaaagcagggaccttgtgtgtcgtttttacactgatatcccttgcccattacattgaatgttattagggatatagtagacactgaataacctttctttgagggggggcgcgtggggaggaggcaaagtcttgctctgtcacccaggctggagtgcagtggtacaatctcagctcattgcagcctccgcctcatgagttcaagtgattttcctgcctcagcctcttgagtagctggaattacaggtgcacaccaccacgaccagctaattttttgtatttttagtagagacggggtttcaccatgttggccaagctggtctcaaacttctgacctcaggtgatccacctgcctcggcctcccaaagtgttgggattacatgtgtgagccaccgtgctcaccctgaataaacattttgagtgaagaaagataaaattggatgataatttttacctactttatagtactgctgtatttcattagcttttttttttttttatctatcagtaaaataccgggtacacatttagtacttgcaaaaatgtcagcctgtgggcatgcacagatacacacaccaaacacgtgtgaaaggaaaatatcttgccaccaaaatcactaggaaaactcaagccagcagggaactgcttagggcaaagctgcttcccattcttttcaaagtcactcctctgctcactgagatggaggcatatctgacatccaatcttttccaaaggattggaaagactaatcagaaactcaaaagaatgtaaccatttgggtatcacctatctctgacctggaagctccctccccacttctgcttcaagtcttcctgccttcgcttcaagttgtcccgcctttccagaccgaaccagtgtacttcttacatgtactgattgacgtctcacgtctccctaaatgtataaaccaagctgtgccctgaccaccttgggcacaggtcattaggacttcctgaggcaaaacaaacttgctaaattaactaagacctgtctcaaatttggggggctcacacactcaaagtatttatacatacacattttttttttctgattagtcggatacatatatgagattcctgggtactgaacaacagatgacaagcatgttaatgtgatttcccaggtatacctattttcctaccaattcttagctaaacaatccagattcttaacaatgcttgcaggcttttaactcaccacaaagttaagatggagaaatacactggcttgctttttctggttatatactggcacgtctattctaagaatatgtaagggtttggtctgtgcaaaaatttcgtgagcaatatcccacaaacacaggcacccatggcaaatatggacaaacagaatcacgtcaagttaaaaagcttctgcatggggaaggaaacaatcaacaaagtgaagacacaacccacaggctgggagaaaatatttgcaaactatgcatctgacaaaggatgaataaccagaatatatgaggtgaaacaattctataggaaaaaaatctaataatccaataaaaaataggtgaacgatttttatagacacttatcaaaggataacgcaaatggcaaaaaggcatatgaaaaggtactcaacatcactgatcatcagagaaattcaaatcaaaactacaatgagatatcaagtcaccccagttaaaatggcttttatccaaaagataggcaataaatgctggtgagaatgtggaaaaaagggaactcttacagactgttgttaggaatgtaaattaatacaactactatggaaaacggtttggagtgccagaaacaataagttcctcttcaaacttccttgttctttctggttgtgtaaacaaccctttgtgtctaattggtaatggacagcctctcccttcccgccaaattggccctattcaatttcaaacaatagccaatcgggtcagcttagattgtgcgatccaactctggccaatggggaaaggacacagaaacaggacctccattagggagaaaaacccttgccctaccctgcttggtgtgctcttgcaattgcatcaaatgcaggcagcaccctcctgcagaagtaaagttgccttgctgagaaattttcagtttaagtgctagttcttctttgcagcaccaagcgcttgttgctaacaatttggaggcttgtctgggatcccattctcctctggggaagggtcttcaataatctctcatgacgagatgcgtcccgctgccatattgtggtggcctcaggagtaagagatcgagacccaccaagcatgacaaataaacttggactctcagtaacatgggaagaaaaggcctacaaataggtaccatggtaaccaggtaactctgtgcacaaaccaaggtaagaaaagccacggggtgtgaagtatttctttggtggttgggacatcctctgaaagccagggaaataaccttgcagatcaaatagctaagcaagctgcctcttccaattttccatctaaccccctgtcttccccctccagctgcaatccccatcttttcccacgcagaccaagaaaaagcaaaaaaaaaataggagctgaggaaagcccagagggaaaatggttattaccagatggaagggaaatgttgtctaaacccctcatgagaaaaatactgtcacagcttcatcaaggaacccactggggtccccaagctatgtgtgacacagtccttagggtttatgggtatatggggatctataccctcactaagcaagttatacatagttgcatagtgtgcagaaaaactaataagcaaaccttaaagaagccacctttcggaggaagaaacccaaggctaaggccattccaaagcacccaagtggactacactgaaatgcctccaataggtcacactcagatgtttattagtaatagtagaccatcttacctactgggtagaagccacacccttcccaagtgcaacagcaagtaatgtagttaaagctctgttggaacatatcatacccaggtttggactaatagagaatattgattcagataatgggacccactttaccatgctcattattaaaaagttaacccaagcactagaaataaagtgggaataccatactccctgacatcaaccctcatcattgaagggtagaaataatgaaccagactctaaaaaaaccacctcaccagattaatcttggaaacccggttaccatgaacaaaatgccttcccattgccttactaagaatcttaactgccccttggaaagaccttggcctgtctccttatgaaatgctctatgagctgccttaactaaattctgcaactgaccttcctacatttgaaacaaaggatcagtttgttaaaaactatatacttggtctgtcttccatcctttcctccctcaggacccaaggccttctagcacaaactccacccttcaaattcccaattcagcaacaccaatccagagatcacatccttatcagaagttggagagagggaaagcttgaacctacctgtgaaggaccttatctggtgctcctaacaactgagacggcagtctggactgctgagaaggggtggacccatcatacctgagtcgagaaggcatcaccatctccaaagtcatggactgtcacccccagaccaaccctcgccagagtaacattaaagagaaaagcctaatctgtctgtccctttttcctcttttctttcctctagctgccctacatcttattattaatgtaactaagtcaaactcacctcaaaccattacttttgatgcttgtcttgttacaccttggggagacttgcgaagtcaaagacagctctctactctagaaaagtatctttgcccttcttggagcttctgagactgggcagattctgttaacgggactcccttagactgggaagattctggagaagattctgttaactgggaatcttgtcctccaagaacagagcttctctgctgtagctgatccaatgttctatggactaccaaaattcaaggttggacctccccaacaagtagctgtgtatccctaaaaccatacattcatttcactaaaggaagcatgcaccaccaactgccaataaaaccaatgtaatccaatacaaatttccattactatctcaagttcacaagattcttccccttcattaagtcgtttttatggtatgggagcagaagtcacaggagcagaccctacaagatattttgaaatgcatttcatggcctcctcattcccctcctccttctccatcttcttctccttctaaaccttctaaccaaactactaccctttccctacccaatagcaacgccaaagtggacattgtagaagttaaatatttaaagcaaactttagccattgaaacagggtaccaagatgcaaatgcttggctggaatggattaaatattctgtctgcacactgaacaaaattgattgttatgcttgtgcaatgggcaggccagaaacccaaactctcccctttccacttggatggtcctctgaccaactgggcatggactatatggtagccttcttccaaaaccacaaagcctagggcagtaaggcatatcaaaccctttcgttgctattcccagaagttaaaagccctgttggtcagcccctgagggccatctgacctccagctatcgatgtcaatttcatcttgtgtctctcaagacaaggggaaaacttggcattccttggaagcctaacagaatgcaatgaatctaagccttttcagaaggtaaccaatcagtctacccttgttcattcccaagcagatgtatggtggtattgcgatggaccactactgggtactctaccaagtaactggagccctctaatccaattggccatccctttcactctggcatttcaccaaccaaataaaaaaggatggtcacagaaaaagaagtgcccctcatgggtcttttgaccctcacgtttatatagatgctaccagagttccccaaggggtgccaaataaatttaaagcctgaaattaaatagccgcaggatttgaatctctattattctggtggtcaactacaaacaaaaatgtagacttgaaaaattacatttactataatcaacagcagtttgtcagttacacaagagatgccattaaaggaatagctgaacaattaggccctaccagccaaatggcttgggaaaataggatagcccttgacatgatactggccaaataaggtggagtttgtgtcacaattggagtccaatgttgtacttttatccctagcaacacagcccctgatggaacaattaccaaagcattacaggatcttaccaccctagcaaatgaattagctgaaagttctggaatagatggccccttttcaggtctcatggagagatggtttgcaaagtggaaaggactcatgacctcaatatttacttctcttgcaattgttaaaggtgtacttattattgtaagttgttgtatcataccttgtatttgtgggttagttcaaaggcttatagaaacagctcttaccaaaatctccctcaattctcctccaccctattcagataaactcctacttctggaccaccaagaagaacaacaaggccaaattatctcagaaaaattttaagaggaagaactataaaaacaagagtggggaaattgccagaaacaataagttcctcttcaaatatcctggttctttctggttctgtaaaccaccattcccacctaattggtaatgcacagactctcccttcccatctaattgaccctattcgatttcaaacaataaccaatcagttcagtttagattgtgtggtccaactctggtccaatggggaaaggacacagaaacaggagctgtgttagggataaaaacccctgccctaccctgctcagtgtgctcttacgattgccatcagacataggcagcacccttctgcagaagtaaagttgccttgctgagaaattttccatttaagtgttggttcttctttgcagcaccaagtacctgtttctaacagaaagttcctcaaaaaactaaaaatagagctaccatatgatccagcaatgccactgctgggcatatacacaaaagaaaggaagtcagtatatcaaagaggtatctgcactcccatgtttgttgcagcactgctcacaatagccaaaatttggaaacaacctaagtgtccataacagaaaaatgaataaagagaatgtggtacatatacacaatggagtattattcagccattaaaagaatgagatcctgtcatttacaatagcatgaaaggagctagaggtcatcatgttaagtgaaataaaccaggcatagaaagacaaactgtgcatgctttcacttatttgtggaatctaaaaatcaaaacaatgaaaatcatggacataaagaatagaaggatggctgggcaccatggctcatgcctgtaatcccagcacttcaggaggccaaagcaggtggatcacctgaggtcaggagttcgagaccagcctgaccaacatggagaaaccccgtctctactaaaaatacaaaattaacaggattacatgcctgtaatcccagctacatcggaggctgaggcaggagaatcacttgaatccgggaggcaggggttgcagtgagccgagataacgccattgcactccagcctggacaacaagagcaagattccatctcaaaaaaaaaaaaaaagaaaagaaaaagaacagaaggatggttttcagaggctgggaagaatagtgggaatgggggtaatgtaggggtaaagtggggatagctaatgaattagaatatataattataagaactactacttgatagcacaacagaatgactatagtcaataataattgtacatttttaaataactagaagtataattagattgtttgtaaaaccaaggataaatgcttgaggggacagacaccccattcaccacgatatgcatatttcacattgcatgcctgtatcaaaatatcttatgtaccccattaaaaatatacacttatgtacccataagcattgaaattttaaaacaaaaaattttaaaaaagaacatgtaagggaacttagaagtattttccccaagtgtatgtgtgtatgtatgggttggtgggggggtggcagtgggtgggcagagtttggagagtgtataagccaaagacacatgctttaaatgctaagcctaatatttaaaacaaattaattttgttctcattgaagtaaaggcaagtagtactgagcaggccaactacacaaatcctattccattctcagacgtattcccagagtaaacacagttcataaaccactgctcaactctaaccttcccatttttcccatgaagaaactgaggctccggaaaggttatgacttgccaacatgacccatgattagtgaatgggtcgggatcaatccaaataatctaaaccccatactagagtttttcccacgataaccacatataagctgtatatttgtgtgtatatatgatttgttcattcattcaacaagtatttggtaaacattctttatgcaccaggcacaatacttagggacagagcagtgaaccggtactcatatcccttcctttcaaggtgttttcgatcttttggggaattagttattttttaaaaatcacacataaaaataatctaattaaattcataagaaggaaagcagcaggagatccaaggtcattggcagcctgaagttaatttctgaatccacctcctttgccacactactgagttacaaaaataaccatgatcccctgttggggcttctattcaatcccaatgtgtttgacatgtagaactcccagaaaggaggttgaggtgcaggatgccatttttttcaataccaggaggagcactgggtggttcaaagcacaaagaacttacttttgtttttgtgtcttagcccatgccagtttctaccatttcattgattactacatatccagaaggtgcttatggttaccaccgacaacatttctgcagttccagagccacaaataggcaacggaaaacctgcttcattcttctaagtttttcaatcttttcctgcagttgtaggcacattggaaatcactttactgttcacgctcgattctggggccttgggaaacttcgtaaggggtgtaggtttcattgtctcagagatctagcacagaatcatttctgctgttccactccagtgacacactgggaataaagggaagttggaatactcataccaccacagagtcagcttgaagattcccttgggtactccaagtcaacctggtgttccttccatctcttaccatggccccctactaggtagagggctaaaagaaactgcagtgcaatggcccttctctggggccccaccactaaacaatcttcacttcatctctaactctcctcccatcccagcttccagaatccacataattttattgtggagacaggagtctatggaggaaacgttacctgaaaagacaaggattctttcacctggtgagtaacaaacaactctccacaaggaagcacgttttgatcaataagagttgtattatcgcaggtaaggagagccctgaaaggattcttcacagcagtgtctccctaagggaaagtgacagaaaggtgctatggggcagatggagaggggagagggcacaacactgcatgtagaggaggggtcccagtggtgcaggcccactgagtcattatgccagcacatgggtggcatgagatggtaatgaagctatagctcagctggggcagtggctcctacgtgtaatcccaacactttgagaggccgcggcaggtggatcacttgaggtcaggagttcaagaccagcctggccaacaggatgaaaccctgtctctactaaacacagaaaaattagccaagcatggtggtgcacacctgtagtcccagctcctcgggaggctgaggcatgagaatcacttgaacccaggaggcaaaggttgccatgagccgagatcatgccacagcactccagcctgggtgacagagtaagaccctatctcgaaaaaagaaaaaaaaaacaaaaagaagaagaagctctagttcctcccaggctggagattttagcatggtgttgaggaaagttcactcaggttcttctgtaagatgccatggtctgtcaagaactgcttccaaccaactaggtgacctcattccatatagcatttgggaaaaaaacaggctgcaaggcaagagtctgtaaaacaggcttattgttcaaatttactaaattcctatagtccttggagaccctccctgtatgtttacataagggagaggtttttactgataatttaggttctacatttaggggccagaaaattcttttttgactgggaagggtggcagtcctgtgcatcatagccatgcttattggcaagatgtcagtagaagctactagttgttataaccagaaatgcctccagagaccggcaagtattttaaggatgcaaaagcaccctcagctgaagtagaattgttactggtttaaaatagaagactaccactttaaattgttttatggaattgcaagtgtaaagacagagaaaatgctcaacactgtggtgccaccactggagcagaccaagaactacctgtcccagcccggccccagccccaagcagggttcagagctgctgggaggctaaagtgactgctgttggctccactgccgctgccagggagaggtgaaggtttcccatcaatttccagctaaaaatgacaaaagcaggcaggcttcgggctcttggatgcacttcaggccaaggctaacacaaacaacgcaaagaaaagcagagagggccactgtgtgtatcgtgtagtttccagaatacaaagccctttatgattataggttctgttcctataagctagctactgtagaattacaaagtattttccagtttatttatttctgagacagggtctcgctctgtcacccaggctagagtgcagtggcacaatcatatctcatagtttactaagaagtaacctgggcaaattaacctcgttgagtacaaacagaatggtggttttcatgtggcttatgtttcttagatcatgctgtaaagccaaaatgttttgaatgttactcattgacagacagcaatcatagtcaagagtctgcgtaataactttgaccagattgctgaagctactgcctaataaatatatactttatttataagtattgccatttccaaattttcttaagcagttccatccataggcttaataatatatacaataaaattttccccttatgccttctgtttcctctgggtctaggctaaatctttgattctactgtttgtagaacctgctttgaccttctttctctgtgtcaccccttctcctggacagcaaatgtagaaatcatcagctgcttcaacagtgaggatcgagtgggccaaaaattcttagggttatatactacaattttttttctaatatatagtattttataaacatcaaaaagaagtctagttctgccaagggtctgtaggcaaaatatcattccactataaacaagtagacatgctagaaacaaaacacaaagccacctttaataggaaagtcttggtatcatgcagtctagacaataattcttcaattagcacctagtggtattagagaaagaaaatagaagagaggtatagaaaaatagaagagataacttgaacaatgagctgagtcaaatgtgctgaacatatgataatttgggataacacaaatctgatgtgtaacaaaatgtgtaaaagttgcaaaagaatagaactcttaataaatgatgctgggacaattggctactaatatggaaaatagaaaaactactataacctacacaaatatgaattctagacagattaaaggcctaaatattaaaagagaagctttaaaactttcaaaagagaatataaaaaaaatttacaacaggcaaaacaaaccaaagatgaaaaagatgagaaatttcactacattaaaattaaagataccgtaaacagagataagatatataagctacatcctagaggagatacttttaatgtaaataacccataaacagtttatatcaagaatagtgaaaacaataaaaaatgtgaatgacccaaaagaaaaatgagcaaaggatatttcatgaaaaggaagaatcacccaacaacatataaaaagatgtatattctcaataatattcaaaagatccaaaataaaaattagatgtcactttatgcccagattggtaaaaattaaaatgtctgagcatgccacttgttagtgagaatgtaggaaagagggaaatactcctgctttgttagtaatattgtcagctgatgtggctaatttagaaaataatttattaataccaagtgaattgaagatgcctttatagtaccatccaggacgcttgtaggtttaggtctttcccctagagccactcttgcaggagagcttgaggcagcacaaacaaggctgtttatattagcaccctttgtaatacaatagtttatacaacctgaaagcctaccaataagaggtaagtaaatatccattagtcacacaattgaaaaatatgcagaaattgagtgaacaagatgaattaaaatggataaatcacaaaaccataatgagaaggggaaatgtaactttttaaaatgtgttcaatataatcctagttttgtaaattttttttaaaatgcaccaaaaatgcacatataatcagtatatgcttatggacatgtagacatatactaatgttgccaaaagatatacggaaattctacacaccaagaaccagatactaagatttctgccaacccttgttccctaacaggtccattcagagaagaatcagggaggaaagttatgggcctgaggttttaatgaatctataaggctttatttctttttaagcacaaagtgatctgaagcaaatacagaaaaatgtgaacatacttaatatcttgacagtgaataaatggacttatattttaattgaataaaactttaatagcacttactatatgccaggcactttactgggcacttaacataaattaataatcttcattatgtttctctccatgatgaaatatttcacacataaacattcctgttgaattaaataaaaaaatctagagggagataccaagcatgattttataaaatgggcaggaatttgagagtaagtagattataatttttattttcaacactgctattatttttaagtgttaaagttagcttacatttctttgtagtttaaaaacattttaaacagtaacgtaaatataattatgataagtatcattgagtgtttgagcatccaaattaagacaaggagcacattccgtaagaaaatcgtaaaataaagcagacatggccagaccctattgtctgaaagaaattagaggactgcaagattagtattaaaaaggagatagatgttgtggtatcgcaggtagatgtgtaatatgcacataggtgtacatttcataaaaggctgactagtcatttgtgttgtactgatggtcaaaaagaaagaagaatcattaagtagaatgtctgttggacaagaaacgacgtttagaaatttctagaagtcaaggaggatagaagtaagttaatggagcaatcttttatatcttgccaagcaactcaaaataggtctggtgagactgcagcatgggactccagccgcactggaaacctagattgtcttgccctccagaagtcctcctaaatgacgtattcatcagggaaaagagttgacaaaatctttcattcccagccctgtggtaatgatgcttggactcccactgagccaatatgaagtgaaaactttgagaagaaaagctgttagcatcaattaagcgataaaacagtcaaacttactgataatgtgtgtgagcatgtctaacacattccatcttaacaaggtgatctcggttaatgcattaattactccttttagctcctgtgttgcagtgataacaatatctcccatagaaatgcttcttcttagtccatgtggggtatttctctgatagaagcagaaataataacagcagtcttcttagactatcaagagatatacaacactatttaagcaatttgaattcaagggatattttccaaagtctctaccaatttggattagttactgaaaatgaattttgggattggttgtcagcctctctcacatatgctgtccagtattcgtgaccccctcctcgctgttaacagaacccatttttgtttaggtatttctcttacccacttaacctatgtgcttcagaaaaactactacctgctataaccctatcctcatccaccacactcctgagctccctgtgcagacctgtgtggtctaaggtggtgccaattgtttgtatgtaggcacttagccccaaagtcttttttctatgtgctccagcaggggaatggtagcctacaaatgacatttcttggagcattttgccagctgggtattgccaataagaagcattggatgggaaataagaaggggtagggagggaaaagctattgtcttcctgcttccagttctggcaaatgattcagtagctgaaagaacctgtagatgactatagattctagcacacaaagtgggacagaggccttttgctttcttacctagtgacagagcaggagtttcatcagaagcagcaccaattcctacaccaggcattgtaccacctgccctctttctttctttgcaaggataggggcaatagtggcttatggcagttactggcctctggctaatttgtctgactccttgatcattccactcttgtaataattttgttaccgaatctctgtatttctttttctttccagggaactgactgattctaaaattaatctcatcctactaccagtgatagcttcaagcataggtatattgtatgatttgagccaacgagaatgcaggaaacatttgctggtaaagtctgggattattttgcttttattttctgggacagtttacagtagcttctctctttctctcttaacaatctcccgtgttcagttcctacagctattttaatcaccctcccggagatttcaatcccaacagaggacagcagggtcaaaagaccgctagaaaaatatacttgggcaagtatattttgtcaccccgatacacaccctacttctggactcccagtaatgggaagccataaatgtctttatttttaagtccctgcgggaagggatttctattattttctgattgctgacacaaccataatctatgaaatggaatgtctaggaagaaattcctgaatctagataactcagcagattgacatgctgggcagcactacaagactgtggcaaggacacagaatgtctgagtgctccctctagggtatttagaccccataatgactttgggggtttcttccgtagttcccttaaattccagtggtctttcatagaaaatatatattaaaagaacataattggctatgcttgcatattcaggacgtacgacacaagataggccatctttaaggtaaaaaaaaaaatgctgtagaatttcagactcagtggctcagaaaaagtctcagacatttaatagtcagaacacctgagaaatttggggacaatttttttttcttgttttgttctgggcgacctaaatttttcttttttttttttcaaatctgaaatacttatcccattaattactagaatttttttccaggcatccttcaaagtccaaggtcactcttctagtctgtttctttctctgaagcatctctttcatcctatgaatcaataatacttttgatttcactctgtaagtctccttccattaggcttttcagtcaacttcatttcaggctggaactggtccccttcctaactcatctctggcttgacaattatctttctaccagcacaacttaggccatatattcatcctatatcccactgcctttgcatagaaggccaaactcattcataattagactccaacttgcctttctactcttatctcttcctttccttgacttccctggttataatcctggtacgctatatttaactggaggaatattcacttttcctcaaacagcatatttacatccatatctatgagccttgttcaatattgttctgttttcctggaaatctcactctatttacacttgatggaatatcagtcatttatatattcagaatacatgtattgaaaacctatgtgctgaacacagtccaaggcactgggcattcaaaatgatacctgccttgggcattcatacataactccatggggaatatataaatgtgtacaaataaaatatagtgtcctaaatactatcataaagtcgtttgaatcatacatgatttgaacacatcttgcatagtattatctgtctatctacactacaaagtttgcaagggtaaagagtgtattatattcattttgcattacctatccttaacctggagcccattaggaaggaaggaaggaaggaaggaaggaaggaaggaaggaaggaaggaaggaaggaaggagagaaagaaagagaaagagaaaaaagagagagaaagaaaagcaaagaacacagagcaagcctctttaaactggtctagctacactgttatatgtcggaactattgacattttacttcagcacaagaggtctcttccctttcatcaactcttacagtagaaaatgactctgacttctgggactgcttgcaggcgagaatgttaacagacctttcggtagctacagttttcttgttgcccattgatggatcaagagctaattctcaaactattttcaagccaacctggtaagtacataatatttattcaagcgacactaagccatttggcatgatttcaacaggaaagaaagggcactttgagaaagggcttgtggtataaatatggttggctcataactgtatgggtgatgcctctgttcatctcctgataggaaggctacgaaatagttctttataactagctctgtttaatattttgcttattctttctgccatcctcacttcagatctgaatgacagtataatcagacagaactaaagcataatcccagcagagaagagaaagaggcgattaggccctactgataaagcaaatgaattctagttcatccgaggggaaaaaaaatgttcaggctacaagacaatgaccacttttttcccaagcagtgggagatttatcagtgacaagtgtttgcttaggtttattttctgaatccattttcttgcatttatagaggagaaatgctgaaaaatggaattcttatgttccattcataatggctttcaaggatgatcttgcatcttttaaaatccattcctctgattggtggaagactttcacctccttagacatccatctaagacagcacttcctttttccatgttttagaaagacagaaacggtttaaaggggcttgtgatttgtttggaaagagggtaaacactttactgtgtttgtgtataggtcacatcatactgattccacttgggcgggtagccagggagagagcccttgtgcaaaatggacattgctttgaaattcagatagtaagagcgggagactggaagtgggaagtgacatgactgagccccacaaaaagggaaaaggacacaaagaacttggaagaaagtagtgtgaggagagacagggagggtctttttgcatgtttactccagtcctatagtaaaagcccataaacatttatgacaagccagaataaatgattaactgcttatggctttcaaaccagaaccagccgcatcacaataaacactatatcattggagagatacctaaacatggataagattctaacttttaaatttttttattttattttttgacctcattctatttataaatattttggggtatatttctgaaagagaaggattttttgaaaacacagccataatagtgttatcgaacacaaatgaaatgacacttcatcaacaatatttcaaatagctagtcagtattaaaatattcccaattgtctaatgaactttaaaaatgtgtttgatttgggatccaaaaattatcccatatgacaggtttctaagtctttgccatgcattttaatctataggttacttttccaactgtttctgcttccctgtgaaagatccttattactggttctaaaataaagcagagttcctggcacatagtgaggattagtaaatatttatagaataaaggacagagaaagaatatcttccactgccctgcttgtggttggaacagtcatttctagaacgatcacctttttgtctttccctttcacctacctgtagcctctcattgggttccttcactgttctacaacctttaaaaatgaagcaggcccattcacgcgtgctcaccaacctgtggcacgtgaagccgttctctgtgctcccttcaagcctctcaacctctcataattcactgaataaatcactttgtgttttccttcccaaatgaggatattgtacacaacttgaaggcagtaaccattcttaattgatctcctatctccagctcctaaaacactttccatcacagagtatactctcaatgaatgttttctgttgttgataaaaattaaaatgaatgtcagttctcatttacagacttaaggattaaagagaaaggccatagaaatgatcaaagctagcattctttccccctcatgtgtagattctagttttccacaggctcctatacaatcaccggttaagcattgctctttgaatcacggtgtgcttttagataagaatggatatggttccttttggatctgtgcgcatgcagcagttttctagtgcattttaattaactccagttttgtttttgcacaaacaatagtagtatgaaaggcaaaagaaaatatgttcctagagtggtcatcagtactggtgcctcagaggaaagagctgagctacaagtggcaattctaaattggagcttgctacaggacagtgcaggggtaaaaatacatttgcactctgagaagaaagactacaattccatttctgatcaatagtgaagcaccctgccaaagcatggctaaagagtcaagttactgtttttaaacatgttttctctctccagtcattgctctcagtgagaacctcgtagtagtggtacaaaatggggcatattttaaagtgacagggcactcctccagtggcctcccatactccagctgcaagcttctgttccactaaagtaggataaatttttaaactccaagtagcactttagctttctcaactgagggtctgagatatgtacttatattccaagtaatacagagatttctgaaaaattaaagcttcaagccatgacttttatttattgtcagttggctggagggtaaaaatagagatagactaacctgccagtgacaaaaatggggaggtggtgcgtattctaggaagtgcacagcaaaaaaataggcaccagagctgcttagagatggctggcaaaaaatgatttgggattaagcctaggaaagtaaatactaatggacttgaacaagagatctggaaaaaaacaagtatttcgtggtagaagggtaattgaaaaggggatgaactaaaaacccctttggatactaatggaactatgtatcctttgttggtctttcttttgtttttcctcccaaatacctaactttgtctcttgttcctcatttccagaattaaattttagcccaagatgtcaatatatgcataaccatatcaaatatgtgagtattaactcattatctaccagctcctcaaacatttataatacaaaacacaaaataaataggattcaattcttgttgattcaacctagttgagaatagatagtccagttaacaaaaaaatgatgaacacaaagggaaagaggagaggaacccgatatatgttctctaggccttttagaaaacatggagttgttcctttggccacatatatgtgaatctataagaaaggtgatattacagacatcaagggaatgggcactgttcaaaaaggaacgccccacaagtgttaccatggcaaaactggaagagtctataatgttacccagcatgctgttggcattgttgtaaacaaacaagggcaagattcttgccgagagaattaaggtgcgtattgagcacacgaagcagtctaagagcagagatagcttcctgaaacgcgtgaaggaaaatgatcagaaaaagaaagaagccaacgagaaagggacctgggttcaactgaagcaccagcctgctccacccagagaagcacactttgtgagaaccaatgggaaagagcccaagctgctggaacctattccctatgaactcatggcataataggtattaaaataaataaataaacaaaagacctctgggctgttaaaaaaaaattgtctaatttatatgacattggtataatttccccagaattcgaatgcaacttttaaagtaaaacctctggaaaataaatcatgcatcattggtcatttacaacccattttaaagcaattcaatagcatctagagcaaaggttacagaagatgctgtcagggtgtctcccatttcctacaccactgaatgtttcccatctctttctgcatgaggacacaatctgtccagaaagctcatgtgtactcttcaagataggatagaagtgccaggaaatgaatgtccccaggagcaaccattaacgagtaatatgtgggaagatgtggataaacacttgagcttgcttgccctcagtgagcagtgctgtagtatgtgctacagtttatcagtgtgtcctctgtgtgattgagtttggaattacaacctcaacgtgtcttaactgcctttccctcctaccatatccctctttcccactcccccactgtactctctgaagttacttcccaaataaactatcagaattcaagttcttgtctcaagatatgctttaaggggacctcaaacattgacaatgatgcacaactgttttaattaattcccatgagaaatggcaattgactatggttaaaatagtgctttcttggcgccatttattcacatacaatgtcaatttttccataccagcattagcttctgactatgatttagctcataacttttctaagtcactttaaaatggattgactttactctcaaatatggtaaaattatacctgaaatcacattgatagccatacacttttcctaatatataaagttatatttttaatgtttgcttatgtgttacatgaaatgttatatttcatgttttgcaaaacactgagctatatagtgtagataagacacatgcatgctttctctgtcaccagcccatgaccccacagttaaggattgttaaggtaaaaatctatcaaattttttactagacactgcccttggggtgttggagaattgcacttttcttgttagatgacttttgtctggattgacaatgtccattttgagttatgagtttctacccagcaggaaccctacctggcaggtttctttcatattagcatccagtacaatggcaccaaaagtgagaaatagatgggggtggtaatagtagtaactggcactcattttatgtctatgaaaattcgttaagaatatataagatgcaaacagaaagaatgcaatactttgggttcatagtcaaaggactagttatcttctgccgatttgtagcaaaactttgtgtttttggagggggtgttttgtatttgaaaagacactattcctcaaaatacaactcaggaccgaaagcttataaaagcactttataaaggggaattaatatttggtttttggtggttttttttcctaaagaggtactccaatttttttctaagtgacaaactttgtttctcaggaattttattgttattactaatttgtgaaccacatgttgcttgttaccaacaaatctaatttatctaattcatgaaaaactatggctaaatttctggagatgtgtgttggggagggaggaaaggagaggctgagatctagcaaaatgctgagacaacatccattgaagtcattgtgcatgcagatctagaaagataagcacagacaggatatgaaattgtgtagactatgaacatctctggttgattaaatggaattgaaatacattttctctttcatattggaagaggcttaacattaaaaaactaatctcttttgagataaagttcattaacacaatgattattcatttggcttttataatgatattgctgcttaatcaccagaacattgcttcctgtgctcggtgggaaccagcaggaaacatttgaagagcaagtcttgctgctaatgtgatgggagagggaatagtattctcactgctcttcatttcaaaagtacagcacattcttgctcagaagtctaaaacctcttgtccgatagcatgagctttaagccccacaacaaacacagaataaagttatataaccctgaaagctaaatctttgcctcaggtctggtgtttctctctggattacacataaaggttctcaaggggggcattttcattacgaaccaagatttgaagtgtttgatcttggtagttgcagataccacagcactgaattcgatagctcatttgactgtttagctcagtaaacaaagacatgaacgaatcgaaccaaactataaatctttaaaactatatcctccttgatgcaagttgaacccacagtgcctccctaaaactaaatagtctatctgcaatggaatcagaatgaaaatgtaatcataagatgtcatatagacaactattaattttcattcaccaaagattcttttgaatgtaagaattgataaactttctgtagggagttaaattattaatacggcacaatatgcaaaattatctaccagtatgtattgcacagtgtagccacagtagtcaaagctgtaagttccaaaaaatagaaaccaactttggatgatttaagcagacatcaaatggattcaaaggatgttaggttaattcacaaaattatccagtaactcaacttcaaaagctgggcgggaacaaagaatgtttgtagtggttaggactgacatcagtggtttcaaacataaaatcatttaaacaaagacagtattttcattgaacattaaacttcccagcccacaatgcacattcatctacaaccaacctagaaatgtaacgtgactgccactaaggctgccaccagtcagaaaaatggtttttctaatgcctctgtgtcttcaagatctggagagtacaattctggagtaggtacacattcctggccaggtaatgcaacatgctcaggcaggcccttgcagcaaagagaccaaatgatcactggcttgattcaccaggactcccaggatttgatgaatttctccaagataaagagttcagatgctggtcagccaaaaaatgacatattttcattatctaccattggataagcccaacacaattacaaattcataacaaggaggtacttagaacatatcttgacatgactgagaacctattattagttcaattggatggttaaaagctttgtttacaacttctccaaacctgaccatatgttcatgtcagaaacaaatcaaccttttctaaccaaccacataatacttctggcctgcttcaatttgcccacagcctctcagctaagccatcagagttgtagaaagaaagaaaaaaaaagagaaagttgtatatagcacaggagattgttaagaaacgtttcctaggccttaggggtgcctttacaacattgacatctttaagacagggacattttccaaagagtgctgacagaggggttggtgtctgtcaagtgtgctgaccccgttttgatcatatccaaggcacttccaagtctcactaactgaacctaaatgatttgggaactcataaagaaacctgataccagggatgtgcactttcattacgatgttccatttcattattttgcaaaaccctggtgaatatatctgactcccactgagatcagatctgaaaagctcacacagagacaagagcacatgggctgaaaatcagagagaggtcactagtggaatgtgagaagctatgttttgacatttgtcaaatgttaacaaaaacaatcctcattaatcttatatctgtgaatagtgaaaggtaacagcaggaacaaataagacatggataatgcaaagcatgagctaatgtaaaatgaattcatatttgattagtggatacacgatgtaatttctgcaatatctatttgttcttatgttttcttctgcgaatgttataattgggttcaactccctgagtacaacctggttaagtgacactgtgcacttaaatattttcaatgaatcatgattaacaacgttttcgtaagtagcagaaatcttacccaggcacaaataggtcggagtgtatatactggttgaaatcacagagagtctcttgagtaagaaaatcttttgagcaggaaatatctgaatcagccagcagtattggaaaagcatgtgtatcagaagacttgggaacattgtgttgtgataaggaaacattaaattcaacagaaattttgatgagaattttagctagaaaatacaatgttatttggttaaggacagaacccccaatcttgtctgaggcaagaattacatgctgaaacctccgccccagccctgggtccagactcctgtgtgaaagagaccgcagtgcagacggctgacttcagcactgcatgtatgctggatgctcaataactgtggaagataatgaagttcaatattgattttttcagtcatatccagacccccagataataagaaatggtgcagtgtcatcacctcagcttaaaggacaaatgaaaaagctcactgcaggatttgcatgttatatctattttctcctttacatgaaatttccctttgcaaatgttatccattggaaattttctgcccatgatttcaaattggctaaacttcaacaggacttagacatacactctgaagtcaggaacacagccctgcattctctccggattctctcatggaataattttatgaccccgggttatatcacttcatctttcttagtctcaattacttcatttgcttaatgaatggtcagagggaaacaatgtcatcaaagatccctttcagtcaaatgaattgaagcaggaacagtctgtcatctcatataatatgaatccctcacttagaagtatgatattttagacttgaactatcacaaggagtattagatcagagcaaaggacgggcttaatttttaagaagcatctagaggtactgaagttaaggttataaggcaaatcacataatcaccatcccaaaatattatatgaaaatagtcatctatcctgaaaagcaggtaactaaattagatcaacacttgagatcccaataagattttctttatatagagagctgtttatctgctctgacttctgtattttaaattattttgggctactatccttccattgctattataaatcattagaaactcaaaattttccttattatatatgtgaaataattcaatgaaaactattaacacagttgaaaacagtagtagatgcagacaagcacatgtatttaatggattcactgctcaacagatgatcagatctatccaaattgtgcatgtctaaagctgtcatcatatctcttacctcttttttatcctcacagtgaagaagaaatgcaacatggcaaaactcatatcttgggaaggcaggtgtttttggtaataacaaaaaagttaaagttgctcaattctcagtgtacagataaaagtctcctgaagaatttaaagatggtaattatgtatactcactaaaatcagttaggaaaacctaactttcattctttgtacaaaaagaaaagtgattatgtatacatatatactataggacacttcaaaaacagtgcataaatatcaggtacatttaatggcatcattgcacagaaagcttatcctgtgtcacagaagcatttcatctgaggttaaaatctccgatgtcggattgcaaacctgctttgtgcaaagcactataataggaagaataatacgttgacaccaaagaaacaggtttggagaagcttagagtctagtagaaaagaacaatagctattcaagtcaaggtttcctgagatcttttcaaactaaccttgatatgaacaatactgccttctttggattattgatacatgaggctgtcacataggtttttgttaactttctctaaattatcaagtcatttgcagcaggtaggccaatcccttcaagcctcttcacacaatcacctgcttaaagaggtttaccttgaccactctacataaattagcaaaactcgttactctattaccatcaaacaaacagaattttattgttcacttcttttctgtttcctcctcctaaaatataaatcctatgagctggcgaacttttgttttgttccctatcttcagttactaggatagtaattaatactcagaaattgcattataaatttttgctgaagaagtaaatggatggatggatggatggatgaatgaatatatgtgtatttcctggcatggatgacatgcactaaattattcaaagaaatagcctactccgagtttatttttaaactattttgtacttttataataggcatattttatttctgcaatctaattttacaagtatttttgtttaaaaaagaataaggattgctgccctgccatgaaataaaatgacaaagaattgtcatttattgtcactaaagattcacacttgtccaatttctaatcattttcagagaaaataatttcaacttttccaccaaagtgacccattccagaatttgacatctcttgttataaggaaattctttttttagctcatgttaattttctctgttttattttccacgtagtctgttttttttttttttttttttttttttttatctttggcaatagaaacaattccatcacaagatgccaacaatttactccaaaaaatataaatagaatgagatgtgcgcgtgtgaaaaccgtatcatccatagtaggaaagggtgtgcccaaaggcaaagaaaaaaaagttttaattcaaatgaaagtatacatatactacgccaagttttttttttttttttttccccagttccaggaactaatgagtaagaagttgttagacttcctcacatgtctaagaactggtccatatttttgtagatgaaacttacagaatttacttgacagcacaaacacgtatatttataaaataaaaaaagatgatggctgtatctctgtctctatttttaaggaagataatgataattattcataatactattttatttcaagcagaaaagaaatattagttaattatgcaattaccatgttttcaccacttacttttctgaagcaacaaaatattatgcagagaaattatatccttttttatcccttaatgtaagaatttcattttagctggtctattcctcatagaatgccaaactactatgatagaaagcatgaataatacacacacaaacgcacacatacacacacacctgcacacacacatccagttgattttaatagcttataaaaagaaattgacaaaatctatatattggtgaatctctacatccacatatctatatcaacctatttagataaatatagatatataaaacacaaattaaattttttattatactttttaagttctagctagggtacatgtgcacaatgtgcaagtttgttacgtaagtatacatgtgccatgttagtttgctgcacccatcaactcgtcatttacattaggtatttctcctaatgctatccttcccccaggcccccaccatgggacaagccctggtgtgtgatattccccttcctgtgtaagtgttctcattgttcaattcccacctatgagtgagaacatgcagtgtttggttttctgtccttgtgatagtttgctaagaatggtggtttccagcttcacccatgtccctacaaaggacatgaactcatccttttttatggctgcacagtattccatgctgtatatgtgccacattttcttaatccagtctatcattgatgggcatttgggttggttccaagtctttgctactgtgaatagtgccacaataaacatatgtgtgcatgtgtctttatagtacaatgatttataatcctttgggtatatacccagtaatgggatggctgggtcaaatggtatttctagcactagatccctgaggaatcgccacactgtcttccacaatggttgaactaatttacactcccaccaacagtgtaaaagcattcctatttctccacatcctctcccacatctgttgtttcctgacattataatgatcgccattctaactggtgtgagatggtatctcattgtggttttgatttgcatttctctgatgaccagtgatgatgagcattttttcatgtgttttttggctgcataaatgtcttcttttgagaagtgtctgttcatatccttcgcccactttttgatggggttgtttttttcttgtaaatttaagttctttgtagattctggatattagccctttgtcagatgagtagattgcaaaatttttctcccattctgcaggttgcctgttcactctgatggtaatttcttttgctgtgcagaagctctttagtttaattagatcccatttgtcagcattggcttttgttgccattgcttttggtgttttactcatgaagtctttgcccgtgcctatgtcttgaatggtatggcctaggttttcttctagggtttttatggttttaggtctaacatttaagtctttaatccatcttgaattaatttttgtatacggtataaggaaggaatccagtttcagctttctacatatggctagccagttttcccagcaccattttttaaatagggaatcagttccccatttcttatttttgtcaggtttgtcaaatatcagatggtggtagatgtgcggtgttatttctgagggctctgttctgttccattaatctatatctgttttagtaccagtaccatgctgttctggttatggtagccttgtagtatagctggaagtcaggtagcatgatgcctccacctttgttctttttgcttagaattgtcttggctatgcgggctcttttttggttccatatgaactttaaagtagttttttccaattctgtgaagaaagtcattggtagcttgatggggatgacattgaatctgtaaattaccataggcagtacggccattttcacaatattgattcgttctatccatgagcatggaatgttcttccatttgtttgtgtcctgttttacttcgctgagcagtggtttgtagttctccttgatgaggtccttcagatcccttgtaagttgtattcctaggtattttattctctttgtagcaattgtgaatggagttcactcatcatttggctctctgtctgttattggtgtataggaatgcttgtgatttttgcacattgattttgtatcctgagattttgctgaagtagctgatcagcttaaggagattttgggctgagatgttggggttttctaaatatacaatcatgtcatccacaaacagagacaatttgacttcctcttttcctaattgaataccctttatttctttctgctgcctgattgccctgaccagaacttccaaaactatgttgaataggagtggtgagagagggcatcctggtctcctgccagtttctaaagggaatgcttccagtttttccccattcagtatgatattggctgtaggtttgtcataaatagctcttattattttaagataccttccatccatacctagattattgagagtttttagcatgaagggctgttgaattttgttgaaggccttttctgcatctattgagataatcatgtggtttttgtcattggttctgtttatgtgatggactgcgtttattgatttgcatatgttgaaccagccatgcatcccagggatgaagccgacttgattgtggtggataagctttttgatgtgctgctggattcggtttgcctatattttattgagaatttttgcatgaatgtttatcaaggatattggtccaaaattctttttgttgtatctctgtcaggctttggtatcaggatgatgctagcctcataaaatgggttagtgaggattccctcttattctattttttggaatagtttcataaagaatgctaccagctcctctttgtatctctggtagaatccagctgtgaatccgtctgttcctggactttttttggttggtaggctattaattattgcctcaatttcagagcctgttattggtctattcagagattcaacttcttcctggtttagtcttgggagggtgtatgtgtccaggaatttatccatttcttctacattttccagtttatttgtgtagaggtgtttatagtattctctgatggtagtttgtatttctgtgggatcagtggtgatactccctctaccatttcttattgcatctatttgatttttctctcttttcttcttagtcttgctagtggtctaccaattttgttgatcttttcaaaaaaccagctcctggattcattgattttttttttaacagtttgtttgtgtctgtatctccttcagttctgctctgatcttagtcatttcttgccttctgctagcttttgaatttttttgctcttgcttctccaattctcttaattgtgatgttagggtgtcgattttagatctttcctgctttctcttgtgggcatttactgctaaaaatttcccttcacacactgctttaaatgtgtcccagagattctggtacgttgtgtctttgttctcaccggtttcaaagaacatctttatttctgccttcatttcattatttacccagtagtcattcaggagcaagttgttcagtttccatgtagttgtgtggttttgactgagtttcttaatcctgcgttgtaatttgattgcactgtggtctcagagacagtttgttgtgatttctattctttacatttgctgacgagtgctttacttccaattatgtggtcaattttagaataagtgtgatgtggtgctgagaagaatgtatattctgttgatttggggtggagagttctgtagatgtctattaagtcagcttggtccagggctgagttcaagtcctggatatccttgttaaccttctttcttgttgatctgtctaatattgacagtgaggtgttaaagtctcacattattattgtgcgggagtctaagtctctgtaggtctctaaggacttgctttatgaatctgggtgctcctgtattgggtgcatatatatttaggatagttagcccttcttgttgaatcgatccctttaccattatgtaatgcccttctttgtctcttttgatctttcttggtttaaaatctgctttatcagagactaggattgcaacccttgcttttttttttgctttccacttgcttggtagatcttcctccatccctttattttgagcctatgtatgtctctgcacgtgagatgggtctcctgaatacagcacactgataggtctttagtctttatccaattttccagtctgtgtcttttaattggggcatttagcccatttacattaatattgttatatgtaaatttgatcctgtcattataatgttagctggttattttacccattaattgatgcagtttcttcatagcattgatggtctttacaatttggcatgtttttgcagtggctggtaccagttttcctttccatgtttagtgcttccttcaggacctcttgtaaggcaggcttggtcgtgacaaaatctctcagcattagcttgtctgtaaaggatttttccttctcttatgaagcttagtttggctggatatgaaattctgggttgaaaattcttttccttaagaatgctgaatattgactcccactctgtggctcatagggtttctgccaagagatccactgttaatctgataggcttctcttggtgggtaacccaacctttctctctggctgcccttaaaatattttccttcatttcaaccttggcgaatctgacaattatttgtcttggggttgctcttcttgaggattatctttgtggtgttctctgtatttcctgaatttgaatgttggcctgccttgctagattggtgaagttttcctggataatatcctgcagagtgttttccaacttggttccgttctccccagcactttcaggtgcaccaatcaaaggcagatttggtcttttcacatagtcctatatttcttgtaggctttgctcgtttctttttacttttttctctaaacttgttttctcgctgtgtttcattaatttaatcttcaatcactgatatactttcttccgcttgattgaattggctattgaagcttgtgcatgcatcacgaagttttcatgacaccattttcagctccatcaggtcatttaaggtcttctctacactgtttatcttagttagccatttgtctaaccttttttcaagatttcaaggtttttagcttccttctgatgggttagagcatcctcctttagctcacagaagtttgtttttaccgaccttctgatgcctacttctgtcaactcgtcaaagtcattctttgtcctgctttgttccattgctggtgaggagctgcgatcctttggaggagaagaggcgctctggttttgatagttttcagcttttctgctctggtttctccccatctttgtggctgtatctacctttggtctctgacgttggtgacctacagatggggttttggtgtagatatcctttgtgttgatgttgatgctattcctttctgtttcttagttttccttctaacagtcaggtccctcaactgcaggtctgttggagtttgctagaggaccactccagaccctgtttgcctgggtatcaccagcagtggctgcagaagagcaaatattgcagaatagcaaatattgctgcctgatcctttccctggtagcttcgtcccagcggggcaccctcctatatgaggtgtctctcagcccctactgggaggtgtctcccagttaggctacacaggggtcagggacccatttgaggaggcagtctatctgttctcagagctcaaatgccatgctgggagaaccactgctctcttcagagctgtcagacagggatgtttaagcccacagaagtttctgctgccttttgttcaggcatgccctgcctacagagatggagtctatagaggcagtaggctttgctgagctgtggtagcctccacccagttcgagcttcctggcctctttgtttatctactcaagcctcagcaatggcagatgaccctcccccagccaggctttagcctggcaggttgatctcagactgctgcgttagcagtgaataaggctctgtgggcatggggcccgctgagccaggcacaggagagaatcacctggtctgccggttgctaagaatgtgggaaaagtgcagtatttgggcaggagtttcccgtttttccaggtatagtctgtcacaacttcccttggctagaaaagggaaatcccccaaccccttgcactttcccaggtgaggcgatgccctgccctgctttggcttgccctccatgggctgaactcactgtccaacaagtcccaatgagatgaaccacatacttcagttggaaatgcagaaatcacccatcttccgcattgatcacactgagagctacagaccagagctgttcctattcagccatcttaaaacagagcctgagtaagatgttttaatcccaaattagatttctaagaaaacaaactgattaactcatacaagaattacagtaggacttttttcttcattatctcaatcgaatgtcacaaaatattacaagttcagtcattagaatatagtgaataagtgctagaaaggaggtatggggaaattatatgactatatgtgaatgtttgatatagctagattgtaaactaaatgatttcatactgtactttgcctaagtaaataactgaagctctatagcgagagttaaatgcaaattatcacgctttattttatattaaagagtcagaactgcgtgagttcaagttttaaattagcataatttttctcaaacatttccatataataacccatattattcaattattttgtaatttatatacgttattataaaaacctattataaaatggttgcttattttttgtcttaatctaacttttctttagctaataagttttaaaaatcagaattggcttggtaccaaataaatacgacctgctacatatttagaattcaggtttgcagatgattttcaaaaacatttgaccatacttggttttcactgattaaaaccacttaaaacatagtcttcttaccagatatcatattttatttaatacatttctattactgagactcacccctttgaatatacaattttttcatgtgtaacagccaagtgcagagtatacatatgaacgctaagtcaccctttcaattattcatcctattgaagtcagaagggttaggattgaatccttactccccgttaaccagatgtgctgcagtggcaatgcattctctttttcaaaagctgtactcatgtcctgggaatggtgacaatgatatccaacttaacgcccactgccagaactagataaaatagcatgggtgaaccatccagaagagttgcttgcacatagcagtcattcaaaataatgttaatccttttctcttccaagccctctccccttaccatgtttgttagtcatgtgtatcttggctaaatttcccaaactttctttgtacctcaatttgtttattggtaaaatgataatattatatgccattttatgtgatgtcagggtcaaatggcagtggaaaaatatatatacttttctatgtatatagtgtgtacatgaaaatgctctgaaaagtataaataatgcaaatatttgagtcattatcagatgagttttaaagtaattaattcaaaatctataattcttgaaagtttatattattttataaagcttgctattcttggaaatttatttttaaaacgggtcaactgttttcttcaaattcacatttatttagggtcattagtttgcactttataagtaactccatctaaatacaacatctttggagcacttacgtatcttttctgctatattaggcttcatgaccacatagttaatatttatatattgatagatatgtctttctttagttccttccacttagtgaatatgcatactccaatcagatggcctgaaaaagtatgcaacatatgcctgcatcagcacaatctgttttaacttctagaaatgcaatgtatgtatgtatacactgaatgcacatattgtatatatgtgcatgtatctatatcctattagttctgttcctccaagagaaccctgactaatacagattttggtaccaggagtggttccagaggaagaaaatattaaaggatgaagttctttcattggctttagggtttctggagttggctgcttaatatgattagacccaaaaatgctaaggactctacttctaatagtatggagaacactgatagtacttggagtaaactgtttggagagttatgcaaaataaatgaatttgatactcctgattcaccactcctgagaggcaaggagtttaatgactctatacttaatacttttgaccatatgtggagaaccagggaacacaatgaagctgtttggttgcttctaagttcagtggacaaagtgatgaaagaaaatgatgaactcagggattctgtgtcccagcttcagaggcagatagtgagcctcaaatgtgctgagattaccctgagaaagtgttatctcctgtagagaaagagctgaaattgtggaaaaacagacaagttttttttgtttgtttgttttttgttttgacagagtttttctcttgttacccaggctggagtgcaatggcacaatctcagctcactgcaacctccatctcctggattcaactgtttctcctacctcagcctcccaagtagctggggatgcccgccaccacacccagctagttttttgtatttttagtaaagatggggtttcaccatactggtcaggctggtcttgaactcctgacctcaagtgatccacccaccttggcctcccaaagtgctaggattataggcatgagccaccatgcccggccagacacaagctcttatcatgcgagtggctgacctgcaatgaaaggtgcacgcacagcctcagcaggtgtctactgttacactgagggcaatgactggaaaagaatgggaccctgcaacttggaatgggaatgtgtgggaggaccctgatgaagcaggagacactgagtttgtaaacactgattaaacttttttgccagaaggaacagcttccccatccccagtagtagcaacatcacctccctgacccatgctgccatcagcctttccaccattgtctgaggagataaaccatgcactgcctgaggcaacagtgatggcctcccctgaggcagttgccaggcaagataacattgattttcctcagaagccacccccaacacctctgtttgcctctaggcctataactaaagcccccgtgggcctctgaaggtgaggttgagagtgtgacccatgaggaggtgtgctacgctcgaaaggaactgtttgagttctctaatttatataaacagcaatctggagaacaagcatgggaatggatattaagggtataggataatggtggaaggaacatagagttggatcaggctgaatttattgatttgaacccactaagtagggactctgcatttaatgttgcagcttggggagttaaaggttttaatagtttatttgcttagctagctgaaatatggattaaaagatagcccactgtgaatgatccagaaatgcctgatatcccttggtttaatgtagaggaaaggatccaaaggcttagggagattgggatggtggagtgaattagtcacgttagacatacccatcccagctgggagggtccagaagatacacccttgaccaatgccttgctaaatagatttgtgaggacagcacctgcctcttagaagagctctgtaattcttctctgtaggtcagatctaacactgggaaccacagtcactcaactccaacatttaaatacaatggggataattggatcctgaggtagcaggggccaactggcagccctcaaccatcaaaggcaaggtgggcatagctaccgtaattgacagcagaggcaaagcagcaatcagaatagtgtgactcctgtagagctctggcactggctaattaatcacggtgtacaaaagaagtgaaattgatagcaagcctactgcattcctgcttaaattatacaaacagaaaagttctaggtcgaatagacaaaagactgatttgaattataaaaacagaatcatggcccctccatcaatttccagacttgagccagtttacagacccagaaccccttgaatgatgggaaggccaggtccccttgaggagggaccccactacattaccaacaatttatgcagtgaatctttctcccatctttcccctaggagaccttcagccttttcctaagaagacccagggaaactgtgcactggggaaagagaaattatcagacatttcaaggactactggacactggctctgagttgacattcattccaggggacccaaaatgtcactgagatcctccaattaaagtaggtgtttattaaggtcatgtaattaatggagttttagttcaggtctgacttacagtgggtccagtaagtacccgaactcaccctgtggtcatttccccagtgccagaatgcataattggcatagagatacttagcagctggcagaaccctcacattggctccctgactggtagtgtgagggctattatggcgggaaaggccaaatggaagccattagagctgcctctacctagaaaaagagtaaatcaaaaacaatatctcatccctggagggattgcagagattagtgccaccatgaaggacttaaaagatacaggggtggtgattcccaccacatccccgttcaactctcccatttagcctgcgcagaagatagatggatcttggcgaatgacagtgaattattgtaatcttaaccaagtggtgactccaatttcagctgctgtaccagatgcagtttcattgcttgagcaaatgaacacatctcctcgtatctggtatgcagccattgacttggcaaatgccttttattccattcctgtccataaggcccaccagaagcaatttgccttcagctggcaaggtcagcaacatacctttactgttctaccttaggggtatctcaactctcctgctttgtgtcataatcttattcggagagaacttgatacgtttttgcttctgcaagataccacactggtccattacattgatgacattatactgattggatccagtgggcaagaagtagcagacacactggacttattgttgagacatttgtatgccagagaatgggaaataaatctgactaaatatcatggaccttctacctcagtaaaatttctatgggtccagttgcatgcagctggtcaagatattccctttaaagtcaaggataaattgctgcatttggccccactataaccaagaaagaggcacaacacctagtgggcctatttggattttggaggcaacacattcctcattttggatgtgttactctgtccaatttactgagtaacctgaaaggctgctagttttgagtggggtccagaacagaagcaggctctgcaacaggctgctgtgtaagctgctctgccacttgggccatatgacccagcagatccaattaggcttgaggtgtcagtggcagacagggatgctgtttagagcctttggcaggctcccacaggtgaatcacagtggaggcctctaggattttagaacaaggccccgccaccttctgcagataactactctccttttgagagacagctcttggtctgttactgggctttggtggaaactgaacgtttgactatgggtcattaagtcactatgcaacctgaactgtgtatcataaactgggtgctttctgatccatcaagccataaagtgggtcatgcacagcagcattccatcatcaaatggaagtggtatatacgtgatcgggctcaagcaggtcctgaaggcacaagtaagttacatgaggaagtggctcaaatgcccatggtctccactcctgccaccctgccttctctccccaagcctgcactgatggcctcttggggagttttccctatattaggttgacagaggaagagaagactagggcctggttcacagatggttctgcatgatatgcaggcaccacccaaaggggacagttgcagcactacagccccttcgtaggacgtccctgaaagagagtggtgaagggaaatcttcccagtgggcagaactttgagcagtgcacctggttgtgcactttgcatggaaggagaaatggccacatgtgcaattatatactgattcatgggctgtagccaatggtttggctggatggtcagggacttggaagaagcataattggaaaattgctgacaaaaaaatttggggaagaggtatgtggatggacctctctgaatggtcaaaaactatgaagatatttgtatcccatgtgagtactcaccaatgactgacttcagcagagcaggagttaattaatcaagtggtaggatggcctgttctgtggacaccactcagcctctttccccagccacccctgtcaatgcccaatgggcccatgaacaaaatggctgtagtggcagggatggaagttatgcatgggctcggcaacatggacttccattctccaaggctgactcggctacggccactgctgagtgcccaatttgccagcagcagagaccaacactgagcccttgatatggcaccattcctcggggtgatcagccagctagctacccggtgacaggaaagggcagaagtttgtcctcacagggatagacactcactctggatatcagtttgcctatcctgcatgcaatgcttctgccaagactaccatccgtggacccacagaacgccttatccaccatcatggtattccacacagcatagcctctgaccaaggcactcactttatggctaaagaagtgcagcagtgggctcatgctcatggaattcactggtcttaccatggtccccatcatcctaaaacagctggattgatagaacggtggaatggccttttgaagtcacaattgtaataccaactaggtgacaatactttgcagggctggggcaaagttctccagaaggctgtgtatgctctgaaacagcatccaatatatggtactgtttttcccatagcaaagaatcatgggtccagggatcaagaggtgaaagtggaagtggcaccactcaccatcacccctagtgatccactagcaaaacttttgcttcatgttcccacgacatcacgttctgctggcctagagatcttagttccagagggaggaacactgccaccaggagacatgacaatgattccactaaactggaagattgccacctggacactttggggtcctcctacctttaagtcagcaggctaagaagggagttacagtgttggctggggtgactgacccagactatcaagatgaaatcagtctactactccacaacggaggtaaggaagagtatgcatggaatacaggagatccattggggtgtcttagtattaccattgcctgtgattaaggtcaatggaaaactacaacagcccaatccaggcaggactacaaatgacccagaccgctcaggaatgaaggtttgggtcactccactaggaaagaaacacgacctgctgaggtgcttgctgaaggcaaagggaacacagaatgggtagtagaagaaggtaggcatcaataccagctacaaccacatgaccagcttatttaaaaatcataggaagcatatttgaaaataataaagcaacaactataaatctgttgtatatctacatgtcacagtgatcccgtgacaatggtggtcctgtatagtattactttttactgagtgactatatatatatatcctattagtatcctaatatagatacgtatatacatatatacatacatgtacatatatacatatatgcatacatataaatatacatatatacacacatataatgtatatctcatacgagtgctcaccaatgtatagatatgtatagatgtatatattgtatatgtatatatacgtatatgtgtgtatatatatatgaagtgttcccatatataatatatgaaggggagtttattaagtattaacttacacaatccaaagctcccacaataggctgtctgtaagctgaggagcaaggagagccagcctgactccccaaactgaagaacttcgagtccaatgttccagggcaggaagcatccaacacgggaaaaagatgtaggctgggaggttaggcccatcatctccttttcatgcttttctgcctgctttacattcactggcagctgattagattgcgcccactagattaagggtagatctgtcttccccagcccactggctcaaatgttaatctctttcggcaacaccctcagagattcacccaggatcaatacttcgtatctttcaatccaatcaagttgacactcagtattaaccatcacaagtccactccttgtcaacttgaacccatacacatcccctgagatcatagataatcttcaaatagagacaataataaggtcaaaattatgcctaacataatacaaccatccttcatacagccagaaacgtaccaatcctcaacccaagtattattacacaaagttaccaatatttaaatgctgatatgaagtcaataaatcttatgtcacatgaaaaaggagaaaggaaataaaatgaagatattttcttagtacaggtgtacacatgcacaaacatgtttttaaccaaaggaggaggaaatactcatgacaattacagtcctcgtttctgcagctggtcatatggagatatagatatatctacatatacatatatatctatatatttatatagatatctacatatacatatatgtctatatatctatatctatatatatctcctattagttctgtccctctaagacagccctaatacagtgggagagaagtgtctggtttcattcttctgcatatagacacccagtttccccagcaccatttattgaagagactctcctttcctcattgtatgtcccttggagtaaaagaaacatagcatgttcttgctaatatgtgataactaaaaagtaagaaagttgatgttacagaggtagagagtagaattatggttaccagaggctaggaaggttagcagggagaaagaggatgaatagggtttggttaatgggttcaaaaatacaatgagaaggaataagttacagtttcaataccacagtagggcaagggtgaacattgttatcaatcattcattgtatatttcaaaatagctagattttggaacgtctgaagacatagtagataataaatgtttgagtgatggatataccaattactctgatttgatcattacacattgtatacatgtatcaaaatatcacaggtaccccatgaatatgtacaattattacatctcaataaaaaattaaaaatttttaaaattaaaaatcagtcatataaaaacctggtcaaaagcaatccaggaaaagggagaagcatatttaaaaatcataaagcacaactatagagctgttatatatctacatgtcacagtgatcccgtgacaatggtagtcctgtatagtattgctttttgcttctaggttgtggcatgtcttggagtgagccatctagggaaactgccaatggttctttacatgtaaagctgaatctcctgcagaaaattctctcagcatcttaagacaccattatctgaatgtgatttaaactcttttttcagacatatagatcgacaatcatcattttcagcccctcagggtgcaggccatttaccaaaatgacaatagcattaaacttattgctattattggtattaatagctctaataacatctacctgatgacttcaatgctgaattaccgcagggttagtcagaagtaatgagctaaaatgatcataaagcccttttcaaatatttcaggtggtacaaaattattacaaatggcaaggtaggtgttgcacgttctctgtgaaacaacgggtgtcagccagataagaagaaagcaacattagctttgaaagtggcactgggggccctgggtcccagccctccctcaagttttgtttcaaatatcagtgttactagacccactttcaaaaatgaaatgggaatcattttcctagggataagtgagaagatgtgccattctcaacctcaacgatgccttttattatgtttccctggctattcttaccatcttcatcatttcttctcacttgcaaacagtgcggccaaggtgtcgtcaccaaatgcttttagatatgcccacacctaccagcttggcagcccgttactaaaggtaaagcataatcgtgcctgatttagagacagtagcaaaaacctctttacctgctagatatgggaattaagtaaactgtgagagactgtgacactgataatctggatatttgctataagcaaaactaattcctagttatggaaacactctaaagctctataaaatgaaactagtaatacctacaaaaaccatgcagttctaatgaaacttaaaagaagttatgcatataaaagcttttctcaactagtaaattgccaagtgttttaaaatattgattgttcatatggaatacagcatttgggaatattatttcaggagtcttgcagtccatggttccaatgccaacttgctccatggattagctctgtgacattgcataggtcacataacttctctgtctcaatcttcttaaaagaaaatgaaagagttcagactgggtggagcccatcgtagtaccgcaaagccactgtagccagtctgcctctctagattcctcctctctgggcagggcatctctgaaaaaacggcagcagccccagtcaggggcttatagataaaactctcatctccttgggaaggagcacctgagggaaggggtggctgtgggcacagcttcagcacacttaaacgttcctgcctgccagctctgaaaagagatctcccaacatagcacttgagctctgctaacggacagaatgccacctcacgtgggtccctgacccccatgcctcttgacagggagacacctcccagcagggaacaatagatacctcatacaggaaagctctggctggcatttggcgggtgcccctctgggatgaaggttccagaggaaggatgaggcagcaatcttcgctgttctttggcctctgctggtgatacccagacaatcagggtctggagtggacctccagcaaactccaacaggaaactccacaaaggaaaacctatcagactaacagcagatctctgcagaaaccgtacacaagccagaagaagtgggggccaatattcaacattcataaagaaaatcattttccacccagaatttcaaatccagccaaacaaagcttcataagtgaaggagaaataaaatcctttacagacaagcaaatgctgagagattttgtcaccaccaggcctgccttacaagagctcctgaaggaagcactaaacatggaaaggaacaactggtaccagtcactgcaaaattgtaaagaccatcaacactatgaagaaactacatcaactgatgggcaaaataaccagctagcatcataatgacaggatcaaattcacacataacaatattaaccttaaatgtaaatgggctaaatgccccaattaaaagacacagacaggcaaattgggtaaatagtcaagacccatcagtgtgctgtattcaggaaacccatctcacatgcagagatacacataggctcaaaataaagggatggaggaatatttaccaagcaaatggaaagcccaaaaaagcagaagttgcaatcctagtctctgataaaacagactttaaaccaacaaagatcaaaagagacaaagaagggcattatatagtagtaaagggatcaatgcaacaagaagagctaactatcctcaatgtatatgcacccaatgcagaagcacccagattcgtaaagcaagttcttagagacctacaaagagacttagactcccacacagtaatagtggaaaactttaacaccccactgtcaatattagacagatcaatgagacagaaaattaacaagggtattcaggacttgaactcacctctgtaccaagtggacctattatacatctacagaactctccaccccaaatcagcagaatatacattcttctcagcaccacattacacttattctaaaactgaccacataataggaggtaaaacactcctcagcaaacacaaaagaacggaaatcataacagtctctcagaccacaatgcaatcaaattagaattcaggattcagaaactcactcaaaaccacacaactacatgaaaactgaacaacttgctcctgaatgactactggataaataattaaagtagagcagaaataaagatgttctttaaaaccactgagaccaaagacacaacatactagaatctctgggacgcatctaaagcagtgtgtagagggaaatttatagcactaaatgcccacaagagaatgcaggaaagataaaattgacacgctaacatcaaagttatatgaactacagaagcaagagcaaactaattcaaaagctagcagaaggcaagaaataattaagatcagagcagaactgaaggagacagagacatgaaaaacacttaaaaaaaaaatcaatgaatccaggagctggtttttttgaaaagactaacaaaacagatagacctctagcaagactaataaagatgaaaagagagaagaatcaaatagatgcaataaaaaacgataaagggtataccaccactgatcccacagaaatacaaactaacatcagagaacagtataaacacctctatgcaaacacactagaaaatctagaataaatggataaattcctaaacacatacatcctcccatgtctaaatcaggaagaagtcgaatccctaacagacaaataacaacgtctgaaattgaggcagtaattaatagcctaccaactaaaaaacgtccaggaccagatggattcacagccaaattctattctactagaggtacaaagaagagctggtaccatttccttctaaaactattccaaacaatagaaaaaagggactcttctctaactcattttatgaagccagcatcatcctgatgccaaaacctggcagagacacaacaaaaaaaagaaaatttcaggctaatatccctgatgaacatcaatgtgaaaatcctcaataaaatattggcaaaccaaatccagcagcacatcaaaaagcttacccactacaatcaagtctgcttgatccctgggatggaaggctccttcaacatacataaatcaataaacgtaattcatcacataaacagaaccaatgacaaaaaccacatgattacctcaacagatgcagaaaaggacttcgacaaaattcaacactccttcatgctaaaaactctcaataaactaggttttgatggaacatatctcaaaataataaaagctatttatgacaaaccaacagacactatcatactgaataggcaaaaactggaagcattccctttgaaaaccggcacaagacaaggttgccctctataaccactcctattcaacatagtaatggaagttctggccaggacaatcaggcaagagaaaggaatgaagtgtattcagataggaagagaggaagtcaaattgtctctgtttgcagatgacatgactgtatatttagaaaaccccatcatctcagccccaaatctccttaagctgataagcaactttagcaaagtctcaggatacaaaatcaaagcagagtgcaaaatcaaagcttgtgcaaaaatcataagcattcctatacaccaataatagaaaaatagccaaatcatgagtgaactcccattcacaattgctactaattgaataaaatacctaggaatacaacttattagggatgtgaaggacttcaaggagaactacaaaccaccaaggaaatgagaggatatgaacaaatggaaaaacattgtatgctaatgggtaggaagaatcaatattgtggccatactgccaaaagtaatttatagattcactgctatctccattaagctaccattgattttcttcacagaatttgaaaaaactactttaaatttcctatggaaccaaaaaagagcccacatagccaacacaaccctaagcaaaaagaacaaatctggaggcatcatgctacctgacttcaaactatactataaggctacagtaaccaaaacaacatggtagtggtaccaaaacagatatgtagaccaatgcaacagaacagaggcctcagaagtaacactacacatctacaaccagctgatctttggcaaaactgacaaaaacaagcaatggggaaatgattgcctatttaacaaatggtgttgggaaaactggctagccatatgcagaaaagtgaaactggaccgcgttcttaaaccttatataaaaattgactcaaaatggattaagcacttaaaagtaagacctaaaaccataaaaaccctagaagaaaactgaggcaataccattcaggacgtaggcatggcgaaagacttcatgactaaaacaccaaaagcaatggcaacaaaagccaacattgacaaataagatccaattaaactaaagagattttgcacagcaaaagaaattatcatcagagtgaacaggcaatctatagaatgggagaaaatttttataatttattcatctgacaaagggctaatatctacaaggaacttaaatttacaagaaaaaaacaacccaaacaaaaagtgggcaaacgatataaacagatacttctccaaagaagacatttatgcagccaacaaacatatgaaaaaaagctcatcatcactggtcattagagacatgcaaatcaaaaccacaatgagatatcatctcacaccagttagaatggcgatcatccaaaaggaatcagcggatatgggggaggatgcggagaaatagcaatgcttttatactgttggtgggagtgtaaattagttcaaccatgtggaaaacagtgtagcacttcctcaaggatctagaactagaaataccatatgatccagcaatcccattgctgggtatatacagaaagtattataaatcattttaccataatgacacatgcacaggcatgtttattgcagcactgttcacaatagcaaagacttggaaccaacccaaatgcccatcgatgataaactgggtaaagaaaatgtaccacatatacaccatggaatactatgcagacataaaaaaggatgagttcatgtcctttgcagggatatggatgaagctggaaaccatcattctcagcaaactatcacaggaacagaaaaccaaacaccacatgttctcattcataagtgggaattgataaatgagaacacatggacatagggaggggaacatcacacaccagggcctttcggggggtgggctgcttaagaagggatagccttaggagaaataactaatgtagatgacgggttgatgggtgcagcaaaccaccatggcacgcatatacctatgtaacaaacctgcacattccgtacatgtaccccagaacttaaagtataataaaaaaaagaaaaaaaaacagactaaaccaacaaagactcaaaaagacaaagaagggcattacatagcagataaagggatcaatgcaacaagaagagctaactatcttaaatgtatatgcgcccaatacagaagtacccagattcataaagcaagttcttagagacctacaaggagacttagactcccacacaataataatgggagactttaacactccactgtcaatatcaggcagatcaatgagaaagaaaattaacaaggatattcaggacttgaactcagctctggaccaagcagacctaatagacatctgcagaactctccaccccaaatcaacagaatatacattcttctaagcaccacattgcacttattctaaaattgatcacaaaattggaagtaaaacactcctcagcaaatgcaaaagaacagaaattgtaacagtctctcagaccacggtgcaatcaaattacaactcaggattaagaaactcactcaaaactgcacaactacatggaaactgaacaacctgctcctgaatgactactgggtaaataacaaaattaaagaagaaataaataagttcttagaaaccaatgagaacaaagacacaatgtaccagaatctctggaacgcagctaaagtagtgtttagagggaaattgttagcactaaatgcccacatgagaaagtgggaaagttctaaaagttgacaccctaatatcatcattaaatgaattagagaagcaagagtaaacaaattcaaaatatggcagaagacaagaaataacgaagattagagcagaactgaaggaggcagagacacgaaaaagccttcaacaatcaatgagtccaggagctggttttttgaaaagattaacaaaatagatagaccactagccagattaataaagaaggaaagatagaagaatcaaatagacacaataaaaatgataaaggggatattaccactgatcttacagaaatacaaactagcatcagagaatactataaacacctctgcacaaataaactagaaaatctagatgaaatggatgcaagggttgttgaacatatgcaaatcaataaacataatccatcatataaaaagaaccaatgacaaaaatcacatgattatctcaatagatgcagaaaggacctttgataaaattcaacaccctttcatgctaaaaactcaataaactaggtattgatggaacgtatctcaaaataataagagctatttatgacaaacccacagccaatatcatcctgcaggggcaaaatctagaagcatttcctttgaaaaccagcacaagacaatgatgccctctctcaccactcctattcaacgtagtattggaagttctggccagggcaatcaggcaacaaaaagcaataaagagtattcaattaggaagaaagtcacattgtctctgtttgcagatgacatgattttatatttagaaaaacccatcgtctcagcccaaaatctccttaagctgataaacaacttcagcaaagtctcaggatacaaaaatcaatgtgcaaaaatcacaagcattcctatacacaaataacagacaaacagagagccaaatcatgactgaattcccattcacaattgctacaaagagaataaaatacctaggaatacaactcacaagggatgtgaaggacctcttcaaggagaactacaaaccactgctcaagaaaataagagctgacacaaacaaatggaaaaacattccatccttgtggataggaagaatcaattaccatgaaaatggccatactggccaaagtaatttatagattcaatgccattcccatcaggctaccattgactttctcacagaattaaattagaaaaaactaccttaaatttcatatggaaccaagaaagatcccatatagccaagaaaatcttaagcaatagaacaaaactggaggcatcacgctacctgacttcaaactatactataaggctacagtaagaaaaacatcatggtactggaccaaaacagatatatagaccaatggaacacaacagaggcttcagaaataacactacacatctacaagtatctgatctttgacaaaactgacaaaaacaagcagtggggaaaggattccctatttaataaacggtgttgggaaaactggctagccatacgcagacaactgaaactggacccctttcttacaccctatacaaaaattgactcaaaatggattaaacacttaaacataagacctaaaaccataaaaaccctagaagaaaacctaggcaataccattcaggacataggcatgggcaaagacttcatgactaaaacatcaaaagcaatggcaataaaagccaagatggacaaatgggatctaattaaactaaaaagcttctgcacagcaaaagaaactatcatcagagttaacaggcaatctatataatgggagaaaatttttatgatctatccatgtgacaaagggctaatatccagaatctacaaggaacttaaacacatttacaagaaaaaaaaaaaaaccatcaaaaagtgggtgaatgacatgaacagacacttttcaaaagaagatatttaggtgaccaaacatatgaaaaaaagctcatcatcactggtcactggagaaatgtaaatcaaaaccacaatgagataccatctcgcaccagctaatatggtgatcattaaaaagtcaggaaacaacagatgctgcagaggatgtgaagaaataggaacgcttttacactgttggtgggagtgtaaattagttcaatcattttggaagacagtgtggcgattcctcaaggatctagaactaaaaataccatttgacccagcaatcctattactgggtatatacccaaaggattataaatcatgctgctataaagacacatgcacacgtatgtttactgcagcactatccacaatagcaaagacttggaaccaacccaaatgcccatcaatgatagactggataaagaaaatgtggcacatataaaccatagtatactatgcagccataaaaagcatgagttcatgtcctttgcaggcacatggatgaagctggaaaccgtctttctcagcaaactaacacaggaacagaaaaccaacaccacatgttctcactcataagtgagagttgaacaatgagaatatttgggcacagagaggggaacatcacacaccagggcctgttgggggagtgtggggcaaggggagggatagtattaggagaattatctaatgtagatgacaggctgatggatgccgcaaaccaccatggcacatgtatgcctgtgtaacaaacctgcactgtctgcacatgtatcccaaaacgtaaagtacaattttttaaaagagaaaagaaaatgaaataaaaaatgatacaggaaccacggttgtaaaaatttaatagaatatatagcacctagcacatatgtgcctggcctattttatgtaatggaaaggcttgcaacttgttgttgttgttgttatctggagtcttaaggcagagcatcctggtggccggcttcagctgctcacacaaagcattattcagctcctcaaaaaaaggcattatttattaataacatgcatcaacttttagtgcaggatagctcaaattcgagtgttcatttacaaatgcaaaaattcccccaagtcctgatttgtttgggggagcccaagaatcttcatttttaatacatattatgagtgattccagtgtttaggaaataacgtcttgaatgtcaaaatccatttcctacatccttcataagtcttctgaagctgacttctccccataagaatgtatttcagagaaacagtttggcacctagtgttgagcgtgattggcactctcactattaactccagaaacttcatctggaacttgtttctgcaattcttgcacatttttagcttgtggctatcacgactgaagcacaaaaccgaacaacttgaaagctttttgaaattctctgaagaccaggcctctgattcattagaaggtaaaaagtgatggctctttgacaaaggggactgggagagaagccaagagggacatatatttgcacgaaagttttgtttaaagaaaaagagaaagagaccaaaaataatgaatctcagcttcatgtgttcttcacccatgcagctttgggctattctttgtttattggtaacaagaatgcctgcgagaggaaagaactgcaaatagaaatggacttgacgtgaatacaataaggtttcaccatggcaaaaggcagtcatggctccagtttactttgtataaaccacaataaggggtggtggagccccagtttcttgcagtgtgtccctctcccacaccacagtgtattgaggatgaatatcgtatgcatacacacgcaagactgaagtattttggtgtcatctagtgtttgggtaaaggttttacttttttctttttctattaatatcactgcagctaacatcagtttgtcatttaatcatcctttactgacacatttatttttgggtctccatcagtgacttttgagtgttcctgaactcagctgagcactgtccctaactggagtcagtgtgtaactgtacccttagactaaaagcaggcacccagccccagccatcataccctgctgttcattgcagccaggttgatgctgtgtctgcaccatggtcttcctaagtccagagctctgctttctgaaactattaagacaacaggctcccattgagctggttttagtgttggacagacctgagttagtgtcctgaatctgcctcttgctagccatgtagccaagagcaggacacgaatttctctaagtctaggttgctcacctacgaaatgaaataataataatagcacctgattcatagagttctcgtaaggattaattgagataatggcaagtatctttgtattattactagtaatgtatattagtgactattagaagtgcttgttaatactgcatcttccagaactgtgtccaggcaaaagaatcaagagtgctgtgatttctatgcacatttacatttgaggcaaactttttaaacatattttgttcactggcatatcttccatacttagaataattcttagcatacagtaggtactcagtacctaatggataaataactaaattaattaattggtgaacattcggccgggcacagtggctcacgcctgtcatcccagcactttggaaggctgaggcaggcggatcactcttcaggtcaggagttccagaacagcctggccaacatggtgaaaccctgtatttactaaaaatacacacacacacaaaatagccaggcatggtgatgggcacctgtaagcccagctactcatgaggatgaggcaggagaattgcttgaactcaggaggcagaggttgcagtgagctgtgaccgcgccactgtactacagcctgggcgacagagtgagactttgcctcaaaaaaaaaaaaaaaaattggtgaacattggtattagtagttcccttctccttgtttgtgactgctccaatgcagtttgctagaccacaagaattcagacatcccttgtgtgtgcgtcatgtatattccatcttaaaaccagcagaggtgagttcttctctgttcttcttactccttcactgcagttacttttatctccctcgtaaccacccagagccctaagaggatgaccttaataggtcatcatcccatttcacatgtaaagaaaccgaggcatggaaatgaaagtgttttgcctaggcttacacctcactgaggttcacaaccaggattctaacacagaaagcctctcttcaggatgtgtccttaagtactatgcaaagaaagatgcaatattatctccctgcatgagggcatccacagaatggaaattgctttttgctaccaaacaaaagccctctaagagtctacctactgtcaagccatttcttcactgagcatatcatgaggaaatactgtttatctagtcattcacagatctatttaagtttaatagatatttattgaatcctgctagaaatgtacacaatatacagggtttttctcttcacagagcttatgctgtagttggcaatatggtgtcattgatagccatttataagtatccttttcatatataaagaacagtgttgtaatgatgtgctatgctaacatttatttccttaattttgaagaaaagatatcaagttttcaaaagatatctaagaataatacaaatgaataacaaaaaaccttgactcccaaaacacatacaggtgtcagtaattatcccagtgatgccctttatagagagagtccaaacccagatcacagttgcaccctattgtcatgtctctatagtctccttcaatccggaacaatccttagttttgacttgactatcttgaatatggcattcgtgaagattacaggtcagtacttttgaagaatgcctctcaaactgggtttatttgatgattttacatcactagacctaagctgtacattttggttggaatattacagaagtaacaccagttttctctcattgagtcttactgggtggcacaagatattggcttgttccataagtgataatgttaatttttgttcacttgattgagatggtatctaccaaagcaggcagagtggctcacacctgtaaactcagcactttgggaggctgaagtaggaggatctcttgagcccaagagctcgagacaagcctgggcaatagagcaagatcttgatgctactaaaaaaaaaaaaattagctgggcatggtggtacatgcctgcagtctgagctgctccggtgacagagggaggaggattgcttgagcccaactgcactctaggatgagtaacagagcaagaccctgtctcaaaaaagaaaaaattcttccagacttcacctttgtaaaattatgccctctatttacagcgaataaatatttttctggtagaagctttgagattacatgaaatcccattcctcgtaccaatttcacttactggttttgacatccattgcaagttcttttataaattaatgtttattgtgaaggttcacatggggattttttaattctgtcatttcttctacctttagtagttaacattctaccctaagaaagaacatcctatccactccatttatccatttatttatctcatgtagaaccatttattcaacagattataatccattgctgccatttttgtgttgttgctgtggcagttgctcaaattttccctgatttggccagtgacagcactttcaatacggctgacatggccccatcatgctttggacaagtccttactctccggcacaacacgatgatccgggttcccttttctttccctgtggcagccctaaaatcagccgttcctccaaggatccctgcttcctttcggtggataatgtttttggaaactaagataggcagcagttaggttcattgctactggggtatcgctgtacctgagcactcccctccctatggacactaatgtagatgttagtaaatataactacaaatgtaatattatatctacatatttacttctatattatatttatatttacttctatgtctatgtatgttttgaaaagaggcattcacatcaacactttcatcccaatcccaaaagagggttcattctaacttttccattttcatatttgcatttccattctccaagaataagaaaaccagccccccttatgtttcaatagatgtgtgtatcagctcaagcccctgaccccactaaactgctgcacaggtgggacaccctcttcacaggggacttgacaccagatggccactgccctaatttgataacccccacctcaatgggggccaaaggttttcgataggcccaaatccggctgccttctaggaagggaacaaaagaaagaaggaggagggagatatggaacaacgccattgatttaaaaaagaatattaatactgtttccagttatgcacacaaaaaacctaagagtcaaacctctctgactgctaatctgtcccaccacagacatttcctagtaaacaattcaaagtcaatagttccttttttgccatgtaggctctgtaaggagctttgtgtgggatgactaatatagaaataaagcatatcattctcccaagagtcctcaaaatgcttaagagcacaaatggtgggggagggtaaattacatccaaatttattataatctggcaaatcatctgatttgaatatactaattacatgaaaatcaatttgttccaatggttttcaattacatctagcaacaacagggggaagggagagtacaaggggttccctttagagccataattgggcagctataattaactacacaccacataaagggcccttcattacataattatgtttgcaattattcctcttgctctttgattttaagtgagaaagcacaactgtcagaaagtaaagtggtaaacatgaaagttaggcttcgaaaatgggtttgggatttacaatgtttagggggtaaataggtagtacagttttgttttgttttttgaaacaaataggaaccttagacactcttggtcaactaattagcacaaattaaaagaaaatccgtttgaggtgtgtgtctacttacaaaccacctgttttccctctttcttagttttttaaatgaaataagtagctctcgtttaaagtgaaccagacagttccccagtgcgattgtctcctgagagaggagaaacgagattcttcaagaaaatgaaaatgtttcatgcctccgttttatcttctgaaaggttacttttaaaagttaactcctaaagagaaacagatgtgtccagaaattaagtattccaagccagaccaggagaaattctctgtgcctggtatagaagtggaagaggtagctttagttgctaaaataatcttacaggaattacttttatggggggatggaggggggctcaggagagcgaggaatggggctaggacagagtttttcatctagttttgttttcagtcacagtgaaaccttggcagactgtgttgagacaaaacacctgcctctttgtattgatagttctaccatgatacattagtaaatgtatagaacaaacatggtttctgtctgttatttgttttgcttttctgagaaaatgaggttgattgcaaatatgtcttctttttattctggagatattttgttgtttttagctaatgcctcctagaaaatcagaccacaattttcactggaattctggtcattttcaaatgagataccttgaaatctaattcaaaaatatatatgtatgacaaaataatgagaaaaaatacaaaaaccaagaatctgaatgattatgcataattcttttctaactgcatccaacagaaacagccacgtgtaatctacttcctcatataagacatggcacaaaagaaaagcaataataattcattcaataacattttcagagatctttttcgcctatctctttatatgtaggcattcccagagatctcatatgcttttctctacctcttggtttctttctgccactctgcctctcttgtctcacagttgagctcacttccatttattgggtttcaactgcacattgcttatttctgaattacagtggcttcttttttgagtccaaacatacccaatgtaagttcccttcaggaaagtgcatctttttctatattcaccaagaatggagacctctagcttaagttttattttccatacatctcctgtcaatttctataaaattttccaaaactctttctgcagcctttttagatgatttccactcttcttgccccaagtcttaatcatctcaatcaagagtacttactatcttctctaacttatttctacctacaacttgtgttgtagtcaaggttttcagattttccaggccacaatcttttcatcactgaaatgggcttcatagtaactctctatattacatataaatgcaatcagattcaagaaagccatttgcttatgcaattgtggagttagttgttcccacaactcatctcccagttgccaaatcatccttcatatagttgagaggtttgttttccctaaaggactaatatgctttttttcccccaattgtcaaaagaatcctaatttcatgctaaggacagaccacaccatgcttttccacagcattgatagggtttggctgtgtccccacccaaatctcatcttgaattgtagttcccataatcctcatgtgtcgtgggagggacgtggagggaggtaatttaatcatgggggtggttaccctcatgctgttctcatgatagtgagtatgttctcttgatatctgatggttctgtaggaggctttcccccttttgctcggcagttctccttgctgctgccatgtgaagaaagacacgtttgtgtccccttccaccatgactttaagtgtcctagggcctccctagccatgctgaactgtaagtcaattaaatctctttccttcataaattacccagtcttaagtatgtcttttctaacagtgtgagaatggactaatccaagcataatctagttaatctttccaagcattctgcacttcaggttcaacaaataactagcttgctgagcatctttcctatcaattttcttgttccatctagaatgtctttcattccaacccctgctctgttgacatctcatctatctgtgtgtatgtatccttcaacctccagctcaaaagataactccactataactttttctacctttgagcacaggtgatcactcatttttctgtattctcataatgtatcaaatatacctttatttaagtctaatattaagttaaacagaagctaatgttatataaaattaaaatatatattatactgtaatatgaaatatactatttatatttcctacttggttctaagcttcttaggagaagtaatcctgactcattcaccaagctattatccacaaaacattgcacatttaggcactcagtaaatatctgctgaatcattaatattttatacattttcaaaaatggtaatatggaattcaaatagtacctgtcttgtgtttctaagagcaagaaaaacatgaaacaaatatgcttgcaagttaattaacttatattatttttgaagcctggatggcactttcatcattatcattgttatatttggaacaaataatctttattgagtgcttaaaatgtgccaggtatgcactaagtgcttttcatatttacatcattaaaatatgaatgatagttcgataaccaagaaataaataaaagctatctataactttgccacagtgtctctgaaagaaatgctgaagtatatttataatgaaaactaaaaaattccttttttcccacaatttcactcttagtatctaacataacccctgaagttgctccccaaatattttcctcccccagtataagctctaacatccatcccttccagtcaacccaagcaagctccctcatcagttttatctttattccctacctgtgtgatcttgtgcaagttatttaaacccactgtgacacaattttctcatctgtggagtgagaatggctaccaatggtatttagcaatgaactcagctgctaaaaagataatctattgcttaaacaagtctgggtatcaatttctcatgtaacaagtctgatggtagatggtagctggccttggtttggggactcaataatgccagggcctctgctctgtaattttctgggccattcactcattttcacagggggctgcttcagcttcagtcaccatgtccatatttaaggccagggaaggggaagcagaggatgcagttgcatgggtaactaatgtgaaagctttccccgaatccccctactgatgcccactggcactcattgtccaaaaccactgcatgggaaactcagaaggtgaacaaccactggaacaccacccaaaacaaaactagttgttcttaatgtggaaacaggggccaatgggatattagatagacaactagtagtgtctcccatactaccttcagtattgtcatgaaggcaaacgagctaattctcatgctgagtatttatcagaatgcctggcaaatgttaaatatcctcttctttacctgctttcagttacacttagttttctaccataagtaattttctactcttctaaatatagacctgccccctaatctgtttccctggttcacccctcattctttaccaccatgcccagtaaggcctagaagttataggatctggcacagagtcctaaaggtcctcctttactaggaagagcaaagcaaactttagagactgttattgttttgttcctgtaacacactcaaaggaaaaaataaaaaaaggcctaggaacaagccatttaaaatgctcatttatttaataactttagctagcagatcagacttaaaatttgttcttccccagtggcaaggtgaggtaaaaatgtacataataagacatattaaggtcatcagcagagcttctaaactttgaaaataaaagctttttgaagtctataattaataagcactatattaattagggcacttcaatcttagaggttccccttccttaacttgagtgaatctttgatatcgaagagcaggggaattctccttcactatttttcattgtaaattccagttaagcaaaacagtcgtctgtcactacgtgatgggcttattattcaaatctcactcttttaataaaattagattatccagtgtcatcaactaaaaacaaatctgtaattttccaaggccatgtctccctttttcattcagaattgaggccacgtgattctcatctgtggaaacaacataatgccaggcattaggatcatccttgtacctaagggaaatttaagaacccctagctagggccatacatggtgggtcatacctgtaatcctagcactctgggaggccaaggcaggaggataacttgaggccgggagtttgagaatggcctgggcaacaaagcaagactccatctctacaaaacattgaaaatattagctgaacagggtggcttgtgcctgcagtcccagctacttgggaggctgaggtagaaggattgtttgagcccaggtgttcaaggatgcagtgacctatgattatgccactgtgctccagcctgggtgacagagtgagacactggctcaaaaacaaacaacaacaaaaaccctagctaaatatacaaataacccacaatcaattgaaatatgctgataatatggttatgatctcaatcagataactaagttttggtcttattcctcagaccaaagctccacctcataaagagttcaaaaaactgtctcatttttgatgtttctttcattcaggaatcacagttttgctaacctacctagaaataagtatgtgtgtgtgtgtgtgtgtgtgtgtgtgtgtgatctgggtgtgtgtgtgtgtgtgtccactccatctatttaccagtttagccataggaatggaatcctgccattcaaccccagccctgctacctactgctgaacatctcagaggccaagaactagcttatagactttatggctggctttcaccaaagcagctaattcagactcatcatcccattgtgaacaaatttaaaaactgaagtcatacatcaaatgactgtttgaaggcataggacagcaaacaacacaaggttataaattcttgagcgaagagaaacatagctttcttctgcagatattttctgaaaccaaaccacagcagatagaacacaaaaagaagcagtcttgttgagtggaggaaacagattagaattaggagagctagagtgactagcagctgggaaggcatgctactagtggggaaaataggacaaagaaggattaacgaaaacatttgtaaagtttcactttgaggctgatcatggtggctcacacctgtaattccagcactttgggaggccgaggtgggcagattgcttgagcccaggagtatgaggccagcctgggcaacatggtgaaacttctctccacaaaaaacacaaatattagctggttatggtggtgcacactaccagctactcgggaggctgaggtggtaggatcgcttaaggccagtggggcagaggttgcagtgagctgagattgcaccactgcattccagcctggagcacagagtgagaccccggctccaaaaaacaaaaagcaaaacaaaactaaaattcactttgttttaattaactccggaagtatatatgtacagtggaagattctcaaaagacacagcattcacaatgtgaaaaacaataaaacttactgtatgtgcaatgaagcatgagtcaataggttttatatgagacagcagaagagaagattagtcagctcaatgacaggtcactagaaatataccaactgaaacctgatgagaaaaaaaattggaaaaatgtgaaagaaacaatacaagagacgtgggacacagtgtaattttcaaacatataatcagaatgcaaaaacgagaagaaaaagaataacagaagtatttgaaaataatagctgaaaatattccaaacacaatattggcagcgcaagttgcaaaaagctcagtaaaacacatgcaagataaaaccaaaggaaaccatacataggcacctcatagtgaaattgctgaaaaccaaacataaagggaaaagtcctaaaagtatccgaaggaataaaggagaacacattactttcagggaaccacaatgataattacagcttctcaacacaattatggcgaaaaaaagacaaaaaaaactacaattcaaaataacaaaagcaaaaaatgccaacatagaataaaaacatcaatcaaaaatgaaggtgaaataaaactctatcaaacaaaagctgaaagtgcagaaaagccctagaaatgtacatattggggtaaatatacaagttcttagactgtctaaaatggaggtctgcaagatttttttatagcaaatacttcaagcttcacagactacacagtctctgtcacaactactcaaccactgccactgtagtgtgaaaacagccatggacgacgcagaaataaacaggcatgggtgttttcttagtccatttgggcggctacaacaaatatctgacactgggtaattaattaagaatagaaatgtattttctcacagttctggaggtttggaagtccaaaatcaaggcacccacacgttcggttgtctgatgagggaatgcatcttctggaagggaggaacaccaaatcctaacacggcagaaggtggaagggcaagctaaccaaatgcacacagccttttaaaataagggccttaatcccattcaggagagaggcgccctcatggcctaatcacctcttaaaggccccagctgttaatatatcacattggcaacacctgaatttttggtgaggacacatttaaatcacagcagctgtgttccaataaaactttactaataaaaagcaggctggcaagcctcttgtttgccaattcctcatttaaagtaacaatgttttgttgagctgttgacaagtagagataaaatctataacaaaaatagcaaaaaaaaaggtgagagaggataaatggaataaattgctataatgttcaaacactgattggcatgtggaaaacataaatttcaagtagattataataaaggcattttgtaatttctacggtcatacaaaaatgttaacaaacattctatcagaagtgataaaataacaaaaaagatcgactactataaaacaatgcaacatagaaggttgtattagttaactttgtacaaacttcagtggcttaaaacaactgttttatttagcttatgatttctttggtttggcttgtgtggccatctggtctggactgcctaagctggtagctgctgggatctctcattgactgtcatcatctgatgaatttgctaggtctttatgacacagattgtcctcaactcacatgtgtggctggtggccaagctggtttagaggaagcctcactaaggtggcacctctctgctctatgtggtctctgattcccaggaggctagtccacttcttcacacagcagtctcaagattcaaatgagacttttaaagtctctgctagataaaatttgctatattctcaatggccaaagcaaaaagaattttttaaataatattttaaaaatagattatatttgacaaaaagaatacaaataatgtttaatagctgaattaaccatgattgaaaataatagctgagaatatcccaaatttaattaaaatcagcagcacaagttccaaaaagctcagtaaaacacaagcaggataaatacaaagaaaaccccatataggcacatcatagtcaaattgctgaaaagcaaatataaagagaaaagtcctgaaagaatcctaaggaataaaggaggacacattactttcaggcaaccgcaatgataatgactgcttctcaacacgaattataaaaacacaaaaataagataatgacaattcaaaataatgaaagcaaaaaatgccaacatagaatagtcttaaaccatactgcaccagtagtcacattactaaagtataagctttatccaaccaagaaatgactgaggaaattacagcagatggagtgatactgagtattttatatatttagttgtagggctaagactaaagtaagaaagtggttgtattagttcaggatcctccatgtgttcagctctctgaaccttgtcctcatggatttttaatggaagcttcatgactttaacattcctttccccagggtaagggtgggaccctctcatggcagggtcttaaactccacaaagagaaaggcaggagaacattagagtcctgcattggagcaggtgaaagaaaggcaggagtacattagagtcctgcattggagcaggtgaaagaaagacaggaagaaggtcagaggctatccctgaggcctaacgcacccaacattctaataaaagactgtaaccagggctatgggagttatgagtgaggagctagggacaaaatccaatatatataacaccacaataatacacacagttattaccaacataagacagaatatagacagaattgaggctaagcagttttagaaaaaaagaggacccaaaaatatacaaaataagaaatggcaaagagaaataactatgaatacagaggaaatttttaaatcatgaaaagactattttgtacacctttgtgcaaatatatttgaaaatctagatgaaatacaatatttcttagaaaaatacagtttaacaactttccatagaagaaaaagatagtacccatagtagataaattcttagagaatacagaatagaaaggaaaacatccaaattgtttgtatgaaaatgttataacattaataggtaaacctgataaagaaagcacagaaaaagaaactatagatgacaaccagttatgaataaaatagcaaagtcaaaatcttaaatgaaatatcagtatctcagcattatcacacattaggaaaacaatacaaatggccaagttggttttatatcagaaatgaaaggaaggttccaagttagggaatttatcaatatgatttaccatattaattgaccttctgggaaaatgtaggcttatctccatgaatgctgaaaaatatttcagtaacataaaatgcctgttattaataaacctctgcagaaaatatgaatggttgaatatatctaaaacatggttaaatacgtacaacatggttaaaaactaacagttgaggactgttagtacctgaacactaaacatcgtatttaatctgaaaacactaaagtcattcccactaaggccagggacagggaaaagatgagggcactgtgtccactactatataatattattctggaggtggtatccaaagcaattataaaataggtaacaattagaggcataagaattagaaaataaaaataataaaatgaatctctatttgcaaatgccatgatagacctttagataagaattatattgagatcaagatctattgcacagcatggggactataattaataacaacgtacagtcattcattatttcacgatgggcatatattctgagaaatgcatccttaggcgattttgtcattgtgcaaaaatcactgagcgtacttacacaaacctagatggtgtagcttgatacacacttaggcggtaaggtatagtctattgctcctaggctacaaaccagtacagtatgacaccatactgaatgctgtagggatttgcaacaccatgataagtgtttgtacatcttaacatagaaaaggtgcagttaaaaatatggtataaaagataaaaaatggtacacatatatagggcacttaccatgaatggggcttgcaggactggaagtcactgggtgactcagggagtgagtgaagagtaagcatgaaggcctaacacattactgtacactatgatagaattgatgcactatacacttagaatatactacatttattttttaaaaaatttttctttaataataaattaaccttagcttactgtaacttgtctactctattaagtgcctcaacttacagtggggttacatccagataaacccaatttaggttgaaaatatcataaattaaaaatgcattgaatacatctaacctcctgaacgtcatagctgagcccaacctactctggctgggctgtgctcagaactctaacagccgtcatttggacaaaaccactgggcaacacagtacactggacagtgtctattgttcactctcgtgatgctgtggctgactggcagctgcagctctctgccgctgtgcagcaccacaagacagcactgaaccatgtatcaccaacctgggaaaagatccaaattcaaaattccaagtatggtttcatgcgtattgccttcgcactttcttaaatttgaaaaatcgtaagtcaaaatatcctaagttgagggctgtttgtattcaaaatgaagaagagttaaattcaggaatgttaggttctaactcatatatagctagaaaagaatagcaaattaaacctaaagaaagtagaaagaggaaatatgatctatatttaagagcataaatccatgaaatagaatatacatgtataacaggaaaaagcaacaaacctaaaagttagttctttgaaaatattataaaattgccatactccaagcaaggataagagagataatataaattacacacatctgcaacgaaaaagaaacaaaacattaccatagagcctactgactttaaaaagagtaagaacacactagaaatcgctgtggaggtggcatgaggaaacattctgggataactgacatgtttaatattatggtctggaaaggagttcaaagggtgtatacatatgtaaaatattttcaaaccctagaattcaggcttgtacactttcctggatataagttagacctcaattattttaaaaagggaactaccttagatgatgagattccatattttcttatatcataattactgcagctgccatggtaacttactgggaaaccttttctgtttcttcttggcttcttgatattacagacgtactcagtctgctctgcccttcacaatttactgaacaacttcctgtaacctatacttgggtttgccccgaagcctgtgctaccttgagcagtcctttctaggttggccagcgtgacaagaatccttaagggatatgtattaaatatatagatcaccctgtcaattcttgttcagtaggtctcagttacagcaataatctttcttttttttttttttttgttctatcaagtttcagtgattcttatcttcagccaaatttggaagcagtgccctaggtggtatgattaattactgttatgattaattaccatctcctcacttgtcccacttcctcacctccctttctgactaggtctagcaggcatcctacttttgttttcaagactgaaagtttgaaaagaggtcagagaaaccatttaagataattttcaatgatagtcaaagctaaagggaaatcattttcttgaggaacttgtgtggtttttcaccttcaatggagtaagagccatgataggcagcagtagaagtctttgatgattttagttctaagaaagaaaactgatacaaacccacttagttggttcagcatattaccgagtatttattgtatccaattttctcaggtttgaagaccacaatgttaccaccattatacctacatctacacaatggtgttgtgtattagtatccagtcttgcagcatttgtgatgatgttctcaaaattttgtgtctgacattttttgtctccacatttttatgtagaaatgaaaagtggaaaaaaggggcaaacctaggtaaagatgagtcatgttggtatcgttttgtgaaggacatgatgtacaactcttccatttgacatttattaagcacatgctatgtacaaggcactgtgtaaggctatggtttcacagcagtaaataagaaaaacatataatcctgttcttactagacttcataataaaattcacagtctaggacagaagagatactttctttaagttaacatacttttcaatatcattgtggtaagttacattaaggagaagttcaaggtaaaatgacgagatgttaatggaggaaaataagcaagtttagaagtcagttaaggttctccatggaaatgatagttagctcatatatttttcctctgatttgtacttttcaatcaaataaatgaatagattacattttttcacaaaaggaaatttttgaaaaacagaggtttgcagttatatgctgtgatttgattctctcggagatatgtcaattaatgtacaaggacaactttcaaagccaaaatactttgagtgtcactgtgattctgctacaacaattgttagcaaagccagctcttttcttcctcctgttttgaaacaagtacccaactgcagttagcttctttgcagatagacaatagaaatagatatgaaaacttaaaaaaaagagaatgactatgtctaggtaggcgtatgtgtgatttttttttttcatttttattggctctgttcaagatacgtgactctagagaacatcagaaatagcatagttgatcagacagtaccatttctgtttctatgtgagcccagggaaataaattacattttttacctttccaactagttgcagtgcatctataaaagtatatgtctatcagtaatatccaggaagaaataaaatctcgtgagtattttctcatgtcctatggtcattgcgtccattttttcaggttgtgttggaggccatatatcacatccaagatctatgcatgtttttttaataactaataagactggtcaggattgtattttttaactaccacctccatcagaagaaacctatatccaaacacaattctttgggttaggggaaagaaatgtatgtcctttataccgaatttaatttccaaaggcaaaactccagcatgatttaggaagtggacatggacctggaagcttgtgatcattttcaggacaaggtcaagttcaaacttacacagctaccacctatcaacggcagaagaagaaagatgacctgaaaactccttttacatcctgtcagagaacagagtgcttcaagtgtatatatacccagactgttacattactgcattagcatagctgttaaatacattgattcaccaagtgaaggctgccatgtgttcctagcactgtgctaggaaatgtgaatacaattgagaataaaaacaaactcaagtttctgccatgacagaacttatattccgctcagagatgggcaataatacactaaaaaagaaatacatatattacaatcatgcagtgcttattatagaggaaacaaagacagttcagcaatagatgccattggtatggagggatcacatagaaagaaatgttaggtaaggtccttataggtggtggtatttaattaaatatttcaaaagtgaaaatatattccagccatgtaaataatgggaaaagtgtcacatccatttgccaagataatgagacaggacctccctgggtttgaggctcattgaggagattagtgtgtttgaagtgtagatgagagtggaagaagaagatgaagtggagaagtgcctggaaaccagatcatttagtgcctcttaattttatacaatttactgaaaataaactatagttgacctttgaacaacgtgagtttgaactactctgatccacttatacatggattttctttcacctctcccacccatgagactgcaaaaccatctccgcctcctccttctcctattatccctcttccccttccttgtgataatttttttttttaatactttaagttctagggtacatgttcacaacgtgcaggtttgttacatatgaatacatgcgccatgttggtgtgctgcacccattaactcctcatttacattagatatatctcctaatactattcccccaccccaggacaggccccggtgtgtgatgttccccttcctgtgtccaagtgttctcattgttcaattcccacctatgagtgagaacatgcggtgtttggttttttgtccttgtgatagtttgctgagaatgatggcttccagcttcatccatgtccctacaaaggacatgaatccatccttttttatggctgcatagtattccatggtgtatatgtgccacattttcttaatccagtctatcactgatggacatttgggttggttccaagtctttgctattgtgaatagtgccgccataaacatatgtgtacatgtgtctttatagcagcatgatttatagtcctttgggtatatacccagtaatgggatgactgggtcaaacggtatttctagttctcgatccttgaggaatcgccacactgtctttcacaatggttgaactagtttacagtcccaccaacagtgtaaaagtgttcctatttctccacatcctctccagcacctgttgtttcctgactttttaatgatcgccattctaagtggtgtgagatggtatctcattgtggttttgatttgcatttctctgattgccagtggtgatgagcattttttcatgtgtctgttggctgcataaatgtcttcttctgagaagtgtctgttcatatccttcgcccactttttgatggagttgtttgtttttttcttgtacatttgtttgagttttttgtagattctggatattagccctttgtcagatgagtagattgcaaaaattttctcccatcctgtaggttgcctgttcactctgatggtagtttctcttttatttatttatttattttttttgagatggagtctcgcttttttgcccaggctcgagtgcagtggcgcaatctcagctcactgcaacctccgcctcccaggttcacaccattctcctgcctcagcctcccgagcagctgggaccacaggctctcgctaccacacccagctaatccttgtgatagtttgcaggacaaggttacgttcaaatgttaacctcctcaccttgttcaatgtgaaaaccaggaggatgaagagtttacgatgatccacttccacttaatgaatagtaaatatattttctctgtcttatgattttcttgataacattttcttttctctaacttactttaagaatacagtatataatatatgtaacatacaaaatatgtgttaaccaatggtttatggtatcagtaaggcttgcagtcaatggtaggctattaatagttaagttcacaggggtcaaaaattatacatggattttcaactacacagggggtcaatgcccctaatccctgagttgtttaagggtcaactgtatataaaaccttcttaactgttggaaatatgtagaagataaagtaagaagaggttgtagaggtgtgagtttttttaaagctaagaaagataatactaggtttttcaattggttgtatcagttctattgaagaaggtacacgactaggatgatatggaatgagggagttactatagaagttagacctaatgcaatgatgagaactgatttaaaaagctctgcaaggttgttgcctttggggctggtgttgagcttaaactgagggagaggaaagacaaattggaacctctcactggctcctcattacctccaaccttgatgatgatgataacctgtcggacgggtgatgactgccacagagttgtgtgcatatctggcctagaactctgaaaaggcaaaggaagagacctgggaggagctggaggagctgagggtctgggtgcactctacaacaactaggtgagctggcatctcagcaacaatatccatggacggctcttgtgtctgacccttggagcatatcgacagctgctactccacttgcaccacccaaatctcccatacatgtcccttgatctaacctggaaccacagaagaaaaggaatttggggagtgtagctactataggtaagttgacacagaacaaaaccattgcatggaaggtaatgacaacaacgaaaactatgaaaaccacttatagtgacatggcttaatcttttggtgttggtagtttgggatgttgttatggtgagcgtgtgcattttgaggaatttgtattgataaaaaagagacatgattctcacatgatctttgttctctcctcttattttactggaagacaaattctcatatccatataaactttgctttgataatctgtgacactgttaataatctaaaattttgcttttataataactttattttgaaccacatacaaccccaagaaacagatgctaaaattaaaaatgtaaattgtggaagactatgtatacattcataattgcctgatattcaagaacacccagaaatatattctagaagattctcagagctggaggaatctatagacccaggggttttcaaatattgtttgtcattagagatcaaagaattcctttatgcagagcattaaaataaaggatgtgaaaaaggctaccaatagctttgactgaggcaggagtaagagattcagtagcacctgtcattttaccttctgtagtcactgaaagaattctaggaaataaaacagaacaccaacctaagaggcctcttgaggctggctctgtctcattctcttcctctttgaagaaagattccatgcgtctattgtagccccaagataaatgcaactacacagcacataaatgggaaattgaactttcattgaagactcttgagtaaagacagggaagaatgttaaccctgttgcccataccatgtggcaaaattgcattaaaatactcttctaaacatgttttttccaggttccttcagccatgcgcttctttccccatcaccaaggtaccacttcctgaaatttcctttttgtctgaataacaacaattacataactcagtgaaagaaatacatttagataatttaaactaccctcctaaataataaaaactctcatttacagagtgcttagtatgtttcaagaagtgtgcaaattgtgttacatgcattggcccttttttgtcccaaaacaactccagtagatagctactattatctcctgttttatagataaagaaactacggcaaagaaatgttaactaatttgtctaaagtcaatcaggtaataagtggtagaggcaggcaacaaatcccaggctgaggtcttcctaagaaagatagcaaggacgcagtattgttattcagtcagagctttgaaatacctcatgctccaccaactcaaaagtattcaccaaacaaaaccagttgcctcctgcgtggtggagaagaagattataatgcttcctgaagaaaatacaatattcattgtaatgttacagctgtttgaaaaccactagatcttctgatgctcacatttttgaaagccaaaacatttctccagcaagtcatcacaactatttgttgagctgagttataatatggcagattgcatattccaaagatattcacaaaaacatcccccgtcccacaagctactgctacactatgactttgacatgcctcccattaagagatagggtttatgctccctccactcaatctaggtgggcttttgactagggtgaatgtaaggctatatgtctttgaaggctagttcctacctggctctcttgggctattcactcttcaaagccagctactagtctgtgaagaaacccaagctagcccactcggaggtcatgtgtaggtgctctagccaagagtccagccaacagccaagttaacaaccagatacatgtatgtaaagacgcctccacatgagacttcctagccgagggcccctgacatcatggtgcagagacaagcaatacaggttctgccctgtccaaactcctgatccacagaatccatgagcacaacactatgagtgtttcatgccactgtgtttttgcatggcttgtcacatagcaatagtaactggaacttacagggaggaaaaaggttcaaagaagaagtgagctctcaaaggtcctagaacttatactcaagatgctctcaaaaatattcactgaatttgactgctgcatagcaacaaagccagtattacaatctcagcagcaccctgtctgctgcagcaccaagttttctccaattacgcttcgacgtaataaaaaataaaaaggagattttgctatcccagctattaaaatccatggtaaccaggactttaaatatatgtaatatatgctgctaaagttcttggaaatactttgttctcatgaataagtaaaatactcttccaaatatttaatttttactttcaaagtagtttcttgactttttgttcccactctagatgcctcctacattgatttctcactctctatgtattccctctcctccagtcaagaagttttgtccagctttactttctggcttatgtaagaaataggtgtagtaaataggctttcccaaacctggcatgcttctgggtgacagattctgcaatagttcctcatctccactggaatcacagttttgtggcaccacttcagaaatcatttttatactcgtaaaaaggtaaatactagcttgttccccacccaaattacaatgatattctaattacttggttccaaattcaccatccattattctctcccagattccctgcaatattcttctatttctgagcaaacatcaattgtgccaatgtcttaagtaccgtcaatctaaactgaaatggtgccagcttccttaatatcatcaccaaataccttattaattaattaatggtgctgtgaataataaagtactggtgttgttaaaccaggcaaaaagcagtaggtaggcaaaggcagcaactgttccagcttaccggaatatctgtcaactagctagaaggggaaggtgagcatttccactggacattaaaacaaaatcagcaggaaaataataataactcacaattgggagccactgtcctgatgaatgctttcgaggtaagatgctcttcaggttggtaaagtgggactttttcacataaagcccaaggtttccgcctactggtaatctaatgagagaagtgctggctcctcttgtgtttgttttaaagcacctttcagaattgggagtaaatgtaattcattggacaggccacacgatgaattggtttcacagtccactctgtcagctttatgatgctgaaagcaaagatggaacaagaagagtgagtattgaggacaaaatagagtgagtaataagagaacaacaaagctatcgctgttgaaaagagcttttactcaagagtattgaatagcacacttacctttttttcctcctccaatccaggtgaacagggctgagaagaccgtcattgtttcaaatgattgatgttatttcttacagtttgtcaccattaccacaagtatggtctggattactttgtttgctcagctgttcctggctctgctcatcttgcctcaaaccaagcaactgagaggggcatggatcatagggtccatcagctgcctgatggagccccacattcgggccttccccctcctctactcatcaatctccattgtcctggcaagaaggtaatgtctgcggcagtacatgccacccccaagctgtacaatacataatacgatcatgctttccaaaatggccagcttactgtgattggttaaatatccccctggttcatgtaaagcatgaagtgaaggaggatgaggggaagttgctgacattttttagtatctgctttgtgaaaggcactgtgctaatttttttcacatatattaccatactatttagccttatgataattctgtggagtaggtatcatttttttcccgttttacagataaagaaactgaggttcagaaataatacacaattcgccaaaggctaatcagttcctagtgtcggagtacagaaaatgattccccaaaatgtggcactggggcatgctgagtgcttctgtaaattgaaagggctcagaaataagcctcagaatcagggttcccctaaccttgtcttgtccccccaccccaccgagtgcagctgcattttgagttaaccctgtaggatgagctttcagagttttacgcctttttgttgtgcagagcaagcacatgattcatcagtttttgttttttatctttagcatgcttgtttttctttttctgtatgtggtgctgtggcttgttgttagacatctgggcagaagagttgagctaatgttgtaagtaaaacacttaaattaaaacttcaaatatctcctcaacttataattaaatgtaccatatggttctattttacggaaagctggggcctaatttaatgttttcctttttcagcaacaaattttactggcttgttctcaatcatttttatgtcacaaaaacaattactaccaaggcaatattttgagattattagacagaaacaacctcttacctggggataaaaatattgtttctggtgtgcctgtatcattatttaagctcatctgggaataaaaaattgttgcttggcttaacatttgttgtgtcagtgtaacaaaggttcacacttttctccatgtttcgtcattttactttctgtttaatttgaacgcaatctgagacaaaatgctgatttttgcacattttaacagatacggttgagcatcatttggggtgttctaaaaatgtccagtaagcaagttacaaatataagaccaactttcatcacctgaaaaagttcatatcttcttgtcaactttactaaaagaggaaagtgggaggtggagactgttaattaatatttaaagagaacagccttttaaagaggcaattccaattttctgtccaccttgcttctgcaggcacattcaatgactccactccttaactctttttaacaagctacttgtttttttatttgaaaggtaagtcatagtttgtaatcttccccaccaaatatattctgtgcaaaattgttcctccagacattattagtcaccagctacataggcatctgttaatatgcttcattgcctaaacgcaacacttaattcattttcatttttaaagtgacacaatctctgcccttcaaggaacacacgatctaaagcaaacactttcaagggtgtaataaccctgaaagtgagaatgtgaatgactgtattatcagctccaacaagaagtcattgtgcacagaaaaggatttatttaaaggagatacttgaatgaattaataaaaactaggatgtaaagtgcttaatttctttaccatatagtcacattttagaatcccatgcagatctgtgaaaaaaaatgaggtagaccaaaacccaagtactgacatgggatcatcaccaaaacaaattaaatttaaaatggcaagttatattaacccaacaaatatttcaggattgctttagtatgtttcaaacactcctctcacttctggttatagcagaatccacaaagtccccgctctcatgcattctgatataatcccaatttacatttttaaaaaataataaagtgatctatgtacagacacataaatctatgtaactgagtagaaagaggcctcgaaggatgcacaccacgtagctgagtgtttgcttctggagagtaaagtaggagcaagaaggtagtgaagggaggcattttgtatgtggagaacaatttgaacaagagttgaaagaaaaagtcactgctagcatcttatcacagtttacaaggaatatgtcctgagactgctcacaatccccgaatttgccaacacagttaattttcccttgaatcatggatccgtggagagtcacatgagcgacccacagtgtgtaaaatcatatccctagtttgatgttatttcattttcattgttttatatatcggttactggactttaagaaaaacaaaatgaacaagaaagactgtcaccttgaaagagtgacaatccaggcgtgagaaaggcaactggcaaagctaagcagagatgcagttgtttggctgttagtttgtttcactgctgaataaataactggcttcacacatcagtcttgtaaggagtgataagaataattcagatttgtagctcaacaaaatgacaaattactatatatcagggctcaccgtgggatagtgaaaatataaatgttggagctgccaagtcacatatccagccttaaaaattaaaaaaaaaaaaatgaaggcagatggtgtctggaaagtgcatcaattctgactctgatgggcttctgaaagactcttgcagggcctggcaagagggtggaagtgtgcaggtgcaaccaataaatagcccagtacaaaagtaagttgacaaatgaaaacccatgccaatcacatagatgatattgctagactctgccacgtgtgaaaacaccttcatgtccgcattggaagagaaaacctctggacttctggcttatgattgaattcccttttgaccttttgttttggaataattggggagaagcatagggtaaaatatcaggtggcaatggtaagcttcctctgggcctaattaatacagaactctttccagcaggggcgtggtctgtatctggaactagctgccttgatgtatgcagtggaattgtctctttataggtaggcaggtttgtctcaggaccctggtagaaagttatctgtctgttttacgaggcccacccaggaaacggagctctgtaattggtaagtgaagttactctgtacataaggagggctttacataaatacaccaaatataacatgatcctagttgtcttttcccaaaacaaagatatttgaactgttgcctaaaactcaaagttactattttgccaccttactaaattgcctttacaggggtcaaaaacttctatatactcccatccatcaactattatcataggcacatttaattttttttttttttgagatggggtctcgctctgttgtccaggctggagtgcagtggcacaatcttggctcacggcaacctccacctcccgggttcaagcgactcccctgcctcaacctcctgagtagctgggattacaggcacctgccaccacacccggctaattttttgtatttttagtagagacagagttccactgtattagccaggatggtctcaatctcctgacctcgtgatctgcccacctcggcctcccaaagtgctgctgccgcgccaggccacgtttacattttttgataatttttgagagactgttttttgggctgttagataaaactaacaccatttttaaaaaactgtttttataatagttgctcacatacagtatacagacaattggaagattaaaaggaaagcatttaaaagttacttgagaatgttgaaaaatagcagtaagtggcagtttaaatacttgttaagtgcagtgtcaaaattgattggggctttatggaaggaatgccaaattttaaaacattatttaattcttcatgtagtcctctcagttgttcttcactgttccaagaatacaagtaaattatttaccagtaacatgttgtcagacatgcaggtgtctcctaatattttttattcacattatcagctccagcaatttaatgagcttcctgccagccacacataagtagatgagataagagaactggaagatctcgtatgtgtgttgcttatatcagaaatgcagatgcatgggtgcacgatcaaaatagactagcaaaccacagcagtgcatcattgtaacagcctggaatactccattaaaacacctcttggtggctcgatttgccttcttgttctagatcagatttcaggtcatttatacacaaacacccatcatagagcccactctattagccacaggaaacattattcactttacacattttcttgtaactaatacttttcccacaaaaatctccacagtaatttttcaaatggtttgaatcttttttattcttgttgttttggtagagaaaaagctttataacctgtgaaaaatgacaagttgaataaattattaaaaggcccttaacatttgatggtgtaagaccccaagaaaagatatccctttaatattatgatgtaaactatcaggaccatactacttgtaagaaaatgacagtaaatccttttgaatatttatttctaagatttacagagtattaatagggtatttcatttcatttgttttaaaaaaaaatcagaacattaagcgatagcatttcctcttcaactatactaaattgtctcgacagcaatgataatattattgctcttaatgtaaagaagaattgtaaatcacttcatctttgtatttatacaagataatatcactattaatgagcaaagtgactcagaaaatgaaacccattacattcctttgatttgactaggttactgaaagtagcaataaatatttgttacaaacaaaaaacagattgtctttgttaaaaatttctcatgaagtagtagggaattaaactaaataccttcattttgaatcaagctgagaaatcagacaatttccttaaaatttagagctcctgctaaaatgagaatatttactttgggcatccactgattaaaattgccagggcatcctttacagcttatatttccgttttcccataaagtagatagaagtatacaaaataaagtaaaactaatgtatcacagcccaagacaactgacctatgtaaaatgattttctttttccacaacatcttctgattgaatttatctttttctctcattcttgctgtcatcttactgaatttaatcagtggaaaataatttgtcaagggaagtttatgcataattatgtttaagcatgagatacttttcttaaaagacacacaaagattatttaataatatatttccatacttaaaatgaatgaacatgttcaaagattgggcttgttgtgcaataacatttcaggagtatttttaatggcatttttttccaataagcaaacatgtatctaaccatgtgataaaaatgggcggaagggaggaatagccacaaagatgaggaagacccagcattggacccaacataaagaatgtttttaaaatgagataattctaagaagaatcacaatggctgcaaagtcaattattctaatcaaatcacatttcaaaatgtaaattcaatttcctataagccccatgtatgcttaacaatttgtgaagcaccctgctatttctatagcttgttagctgactttcttgaaatgaagactttgtcagaagaacatctgtgctctttattctcatctatgtttctcatgaactgtggagtaaaagtattaatacagcgacggtgctgatcgattgattcaacacacatttagtgagcacctactgtgttccaggaacatgatgttcagtttcaattaagtcctttgcaacttggaatccctctatcactaattaactgtttgaaattaaaaatacatcagcacacacaggctatcctgttgttgctagctttattctcttcaaattaatgaacatttgaatatagctagatttcactgaaataataaattctcgttcttgtgctattgcaaattatatcttttgataaagcaaccttgcggagcagggatgtgaatgacattaagttgaggaatgcatctgtttgcagtgggagaatcaagaatatttgaataaattattgatatgttttctgatcaaatagttgtgatgattacatcaggcatttggaattattccaatgctgctgtcttacaaacttcagtgtatccagacctacctactacccaatattttcccttaatatactataatgtgtctgttcctctatttcagaagctatgttttgtcccagtgtgaatatcatctaaggatcaactttattaatctagccctttttcattttaacagcttaattaaatcatcataaaacgtactgttttcctgtgaggataaagatccatttccttagcctttctcttcaacatagtaaatctctgaaaaagccaccttcttggcatttcctaaactgcactttttccaaatctattttcgtttccttgaggaattccataatgacccatccaatacttcctgtgggtgaggtcaaattgtgaacagcacagcttcctagatttattaccttttctgctagaaacaaaccaagaaccctcctttctttattcagtgccatctcatattgctttttcactttgcaaatttgtcacagtctggttgtaggttaccttttcttttttttttttttaacttttggttatacacacgtcttgctctaagcttgtttacactgtgttataaatatacttcttatatctttttccagtaaccaagtgatacaagttcctggttcccttgaagtcatttttctcactaagaaaaaagaatgacctgagcaaaattagatgacagcataggatagcagagtgttagtgtcatttctgaaggaatgacagggtagtgtgtttgtttatctgtttctggactctgtatttcttaaattttatttacataaacctaattattgagttcagttaaaaataaacagcaacaacaaaaactaaaatcagtaatctcaggggaaaaatgggatgaagcattagttaagttatatgtaactacgataaaatattttttgtcctatattcatagactttttatttagtctagaaaaatgcaaaccaaacaaaattcaatgatgaaaacactctagatgttcactgttcaatgccatgacccctccccagatgtggctattgagcactcgaagtgtggctagtgggactgacgcactcagtttgtggtttcgtttttttttttgtttttttgttttaagacagggtcttgctctgtcacccaggctggagtgcagtggcacaatcatggctcactgaagctttgacaccccaggctcaagccaacccccaactcagtctcctgagtagctgggactaaaggcatctaccaccacacctggctaatttttaattttttttttctttgtagagacagaattttgccatattgcccaggctggtctcaaattcctgggctcaaagtgctaggattacaggcatgagccactgcacccagcctcatttgattttaattaatttaaatttaaatagcaacatgtggccagtgtctactatattggacaacacaagtctaaaatataaatataaagggtaattctgaagggatttattaactaaattatagttttgaggaaaattatggcttgtcttacaaaggagcattattttaataattatttaatgtaatcacaatagtccctttattgtaaacattcctgtttcttttaaaaaatgaatgtttaaacatctgtaatatcagagctggattatatcatcaaattctcacaggaaccctctaagttaagtattcctttaaacttatattacagctaaggtaacaaaagcttagaaaagtaattttcctgaagtcacacagctataatacggtagtacctgtttagaatccatatatttctgattccaagttacaagatcttaacaagtctaacacacatttttaactgcctgctatgtcccagacattgctttgtagaccatcaacagaatagaaataatatcaaaaaaatgtttttattgacactaaggtgaggtaacatgtaaatagtagctactgctcttttctaataagatgatccataggtctagacataaagaaacacataaactcagtaaatatacacatatactcaaagtctgaaaacatgagcattttttaggacttaacttgttaaaatgctttttagttcaaaacacttaaactttctcaatttaaaaagattatgaaacatctttcaagtgcacgtatgacttggcaagaatgtagggacagtttcttgacgctcaaaaagacaaaagcacacaacagcagtggctggtaagcatcaggagggacaactgtgctagtaacatatgacaatccatagtgatccagtgctgtgctacgaaaagtgtggtctgcagaatagcagcagtacatcaactggcagcttgttagaaattaaaacatacacacacacacacacacacacacacacacacaatgaaaacttagaccctactagatacctatggaatcagaatctgcatttgaacaggatccccaggggagttgatgggaagaatattttgcagtgtatctacccttttgggatgactgcttttaaaatgcctccaaagtgggcactagagtcaaactccagggtctatgcaaggttcaaagtggggtctagaattggagctcaaaattagtaacccagaaaggcaaggcccgctgtgaaagggtgaaccaaccaaagcccaccattaataaatacatgctaggaaaacttgcttatcctagtttagggacagctctgggaggatggggagtctttcctgaaatttcacaaacaaaggaaagacctgatgagttttaggctaagaattcatatcatcccacgtggcctcaaaatcctaagcagaataattcaggctaatgtggtgataggttgttagtgcctaaaggaaactgatacaatggagcaacatactttaaaaaaaaaggcctcaaacatttcccatacatatgattcattgactatgaattcacaacttaaaaaactaagaaaagaaagaaagaaaaacaccagccacaccagcaagaatcagcagaaacagcaaacatcagaattagacctactaagactacaggcattgaatttttagctatacagacaataatttttagaaaaaatacataattaaaattaaaatgtcagttacaatagcaacaccaccaacaagaaaacaaggtatccaggctacaaatatattttgttttaattcccagcaacttaaaggagaaacttattttttaaactttctttaaatacattaaaaagacacatgattccaaaatggaagcacagaagaaagctacctttactccccctctcccaccagaaaaccagaaccaaatatacaacactgaatttatcaccagcaataccccagaactcacatataaagatgagacagttcctagggccatagattaagtgaaaaaactctgggcagagagaattggacttctgtttctgtgacacccctccctgcaacatgtctggccccaagcatgttgaaactcacagtttcaacactggaaaaagtcggattaaggtagacaaccagcttccccaccatcttaagttccttagcaggagacctattccggcgtgaacccacaggaagcactgggggtaccagaagggagaaacatcaaggacagccaacgacagaagggggaagcaggactaccattcccatcactggaaattctgtcctgtaactatgccaaaaagatgccacatcacagtgactattcagctgcgctatcctgtaggaggtttgttccacaggccttctggtcatgaatccctaaccagtcttcccacactactgggatgtcccctttgggatctccttgcttctggactagtggtactctgattactagaaccaaggcaaacttgagcttaaggtatcatttagctctgaaaaggaggtagtgacctagcaggaaaaaaaataaagaaagaaggaagaaaaagagggggatgggtgagaagaagaagaaaggaagaagaagaagaaagaagaagaaggaggaggaggagggagaggaggagggaggggggatgggtgagaagaagaagaaggaggaggaggaggagggagaggaggagggagagaaagaaagagagaaagaaagagaccaaagagagaaagaaaaagaaagaagaaagaaaagaaaaagaaagagaaagaaagaaaaagagagaaagaaagaaagagaaagaaagggaaaggaaggaaggggagggagagagggaaagaaaatcaacaggtaaattacaaagaatttctaagcaaacatatccagtaaaaaccaaaacaagccacacagagaagactggaataaataatagacataagtccacaagaaacaacagcaaacagggaactgtgacctctgcaaacagaaaaaggcaaggaaccagtgatgaaactctaatgagacagcagtatgtgaactctgaccaataattcaaaatagtagttttagggaaattcagtgatctccaagagggaaacacagaaaagcttttcagaaatgtaccagataaatttaatagattgaaataatttttaaaaatcagacagataccttggcacaggctgggaatggtggctcctgcctataatcccagcacttttggaggccaaggcagcaggattacttgagcccaggagttcaagaccagtctgagcagtatggtgagactctgtctctacaaaaaaataacaaaaaaatggccggacatggtggtatgtggttgtagtcccaggtacttgggtggctgaggtgggaagatctcttgagcctggatgattgaggctgcagtgagctgtgatggtactactgcagttcaagctgggttacagagtgacaccccgtctcaaatttaaaaaaagaatgaaagaataaaaaaataaatcttggcattgagaaatacatttgctgaactgaaaaatccattagaggctcccaacatcaaaatgaatcaagcagagaaaataataaatgagcttgaatacagtttatttgaaaacgcacagtcaggccaggtgcagtggctcatgcctgtaatcccaacactttgggagactaagcaggcagatcacttgagcccaagagttccagaccagcctgggcaacatggtgaagccccattactaccaaaaaatactaaaattagctgggtgtggtggcatgcacctgtagtcccagctacttgggatgctgaggtgagagaatcacctgagcctgggaaagcaagggtgcagtgagccatgatcctgacactgtactccaacctaagtgacagagtgaggccctatgaaacaaacaaaaaacaaaagcaaacaaacaaacaaaaaacaagaaagaaagaatatgcacaatcggagcagaaaaaatgaaaaaaaataaaaagaatgaagattgcctacaaggtaaagaaaattacttaaaaataccaaatctaagaattattggtgttcaagaggaatttgagcaagagcaaagggtagaaagattattcaaagaaataataacagaaaacttttcaaaacttgagaaaaaaaaaaaagaaatactgagataacagaaggtcagagaacaccaaataaactgaataggaaggaatacttccaaactcactcctatgaggctcgcattaccctgataccacaaccagacaaagacacaacagaaaaagaaaactacaggttaatgaacataactgatgatcacagatgcaaagatcatcaacaaaataataacaaaccaaattcaacaacacattaaaaagttcattcaccatgactgagtgggattaatcccagggatgcaaggatgctccaacatgtacaaatgttagaaggtgatatatatcacattaacaaacccaagaacaaaaacgatatgatcttttcaataggtgctaaaaaagcatttgataaaattcaaatcctgttatgataaaaaccctcaagaaattgggtatagaagaaacatacctcaaaataataaagaccacatatgacaaacccaaagctaacgtcgtaataaatggtgagaaatggagagcctttcttctaagatctggaacaagaaaaggatacctactttcaccactttattcaacataatattggaagcactggcaaaagctattagacgaaagaaataaaaggcatcaaattggaaaggaagaagtcaaattagcatagtttgccaatgacatgatcttgtacttagaaaaaactaaaaatttcaccaaaaaactattagaactaataaacaaacaaagttgcaggataaaaaaatcaacatacaaaatcagtagcatgatatatgccaacagcaaacagtctgaaaaataaatcaatacagcatcatttacaatagctaaaaacatatgaaacactgataaaacaatttaataaaagaagtaaaagaaagagggacctgactatttaaagaaaaacaaacaaacctaaagcaacaacaagagcatcaacaaaaaagtccccaccaaaacctcatccaagggccagcagcctcaaagatcgaaactagacaaactcttgaagatgataaagaatcaataaaaaaaatgctgagacctcaaaaggccagagtgcctcttttcctccaaatgatcacaacacctctccagcaagtgcacagaactggaaggaggatgagatggacgaattgacagaagtaggcttcagacggtgggtagtaataaacttaatacacttggctgaggtaaaggaccacgtcctaactcaatgcaaagatgctaagaaccatgataaaagtttacaggagctgctaactagaataaccagtttagagaggaacataaataacctgatggagctgaaaaacacagcacaactatcagtaactgaaataatcaagtggaagaaagaatatcagagcttgaagactatcttgctgaaataaggcaggcagaaaagactggagaaagaataataaaaaggaatgaataaaacctctgagaactatgggactatgtaaaaagactgaacctatgactgattggagtacctgaaagagatggggctaatggaaccaagttggaaaacacacttcaggatatcatccaggagaacttccctaacctaacaagacaggccaacatgcaaattcaggaaatacagagaactccagtaaaagatactccacaagaagatcaactccaagtcacataatcatcagattctccaagatcgaaatgaaggaaaaaactaagggcagccagagagaaaggccaggtcacctacaaagggaggtccatcagactaacaacgaacctctcagcaaaaaccctacaagccagaagagagtggtggccaatattcagtattcctaaaaagaagaattttcaatccagaatttcatatccaggaaaactaaacttcataagcaaaggagaaataaaatccttttcagacaacaaaatgctgaaggaattcatcaccaccagacctgccttgcaagagctcctgaaggaagtcttaaatatagaaaggaaaaaccagtagcagccactacaaaagcacactgaaatacaaaggccaatgacactgtgaagaaacaactactatgcaaattaactggctaatgtcatgatgacaagatcaaattgacacataacaatatttaccttaaatgtaaatgggctaaatgctgcaattaaaagacacagactgataaattggataaacagtcaagacccattggtgttctatattaaagagactcatctcatgtacaaagacacataggctcaaaataaagggatggaagaaaatttaccaagcaaatggaaagcagaaaaaagcaggagtttcaatcctagtttctgacaaaacagattttaaaccaacaaagatcaaaaaagacaaagaagggcattacataatggtaaagggatcaatgaaacttagaagagctaactatcctaaatatatatgcacccaatacaggagaacccagattcataaagcaagttcttagagacctacaaagagacttagactcccacacagtaatagtgggagactttaacactccactgtcaatattagacagataatcatccctttatgttaaaaactctcaataaacaaattattgacagaacatatctcaaaacaatcagatctctttatgacaaactcacagccaatatcatactgaatgggcaaaagctggaagcattccctctgaaaaccggcgcaagacaaggatgccctctcttaccacttctattcaacttagtattggaagttctggccagggaaattaggcaagagaaagaaataaaggtattcacataggaagagaggaagtcaaattgcctctgtttgcagacgacatgatcctatatctagaaaaccccatcatctcagcccaaaagctccttaagctgataagcaacttcagcagtctcaggacacaaaatcaatgtgcaaaaatcacaagcattcctatacactaataatagacaagcagagagtcaaataataaatgaacttccattcacaactgctacaaggagaataaaatacctaggaatacagctcacaagagaggtgaaggacctcttcaaggagaactactaaccactgctcaaggaaataagagatgacacaaacaaatggaaaaacattccatccttgtggataggaagaatcaatatcatgaaaatggccatactgcccaaagtaatttataaaatttgtagattcaatgctattcccatcaaactaccattgacattcttcaccaaattagaaaaaaaaagctactttaaaattcatatggaacaacaacaaaaaaagcccatatagccaagacaattctaaccaaaagaacaaagctggagtcatgctacctgacttcaaagtatactgcaaggctacagtaaccaaaacagcatggtactggtacaaaaacagacacatagaccaatggaacagactagagatctcaaaaataagaccacacatctacaaccatctgatcttcaataaacccgacaaggacaagcaatgaagaaaggacttcctatttaataaatggtgctgggaaaactgggctagccatatgcagaaaactgaaactggacccccttccttacaccttacacaaaaattaactcaagatggattaaacacttaaatctaaaaccccaaactatgaaacccctagaagaaaatttcggcaataacattcaggaaataggcatgggcaaagattttatgatgaaatcaccaaaagcaattgcaacacaagctaaagttgtctaatgaaatctaattaaactaaagagcttctgcatagcaaaagaaactatcattgctgtgaacagacaacctacagaatgggagaaaacttttgcaatctacccatctgacaaaggtctaatatccagagtctacaaggaacttaaataaatttacaagaaaaaaaacaaacaacaaatccatcaaaagtgggcaaaggacacgaacagaaacttctcaagagaaaacatgtatgcggccaaacaaacatgaaaaaaaagcttaccatcaccaagcattggagaaatgcaaatcaaaaccacaatgaaatactatctcatgccagtcaggatgtcaattattaaaaagtcaagaaacaaaagatgctggcgaggctgtggtaaaattggaatgcttttagactgttgttgggaatgcgaattagttcaaccactgtgaaagacagtgtggcagttcctcaaggatccagaaccagaaataccatttgacccagcaatccctttgctggatatgtatccaaaggaatgtaaatcattctattgtaaagatacatgcacacatatgttcattgcagcactatccacaatagcaaagacatggaataaacccaaatgcccatcaatgatagactggataaagaaaatgtagtacatataccctatggaatagtatgcagccataaaaagaaacgaaatcatgacctttccagagacatgggtgaagctggaagccatcatcctcaacaaactaacacaggaagaggaaaccaaacaccgcatgttctcactcataagtgggagctgaacaatgagaacacatggaaacagggaggaaaacaacacaaaccagggcctgttggtgggtgggggagggagagcatcagaacaagtagttaattcatgtggagcctaatacctaggtgatgggttgataggtgcagcaaaccaccatggcacatgtttacttatgtaacaaacctgcacattctgcacatgtatcccagaatctaaaataaaataaaatttaaaaaaataaaaataggccaggtggggtggctcacgcttgtaatcccagcactttgggaggctgaggtaggtggatcatgaggtcaggagttcgaaaccagcctggccaacacagtgaaaccccgtctctattaaaaatacaaaaattagctgggtatgatggcaggtgcctgtaatgccagctactagggaggctgaggcaggagaatcacttgaacctgagaggcagaggttgcagtgagccaaaattgcaccactgcactccagccagggtgacagagctagactccatctcgaaaataaaataaaataaaattgaaattaaaaaagaagtaaaatatctctacaggaaaactataaaacactgttgaaagcaatctagggggacacaaaaaaatggaaaaatattccatgtggattgaaagaattaatattgttaaaatgacaattctacccaaagtaatttacaaattcaatgcaattcctatcgaaataccaatgagattcttcacagaaatagaaaaaataaattcaaaaatttatttgaaacgtcaaaagacccataatagccaaggaaatcctaagaaaaaagaacaaagctggaggcattatactacctgacttcctgatttcacaatatgctacaacgctacagtaaccaaatcggcatggtactggaaagaaaaaagagaagaaaagaaaacttaagagagagagaaagaaagaaaagaaggaagggagagacggagggagggagggtgacagagaggaaggaaagaaggaaggaaggaaggaaggaaggaaggaaggaaggaaggaaggaaggaaggaaggaagcagagacatagaccatggaacataataggaaacccacatatcaatccacacatatacagccaaatcattttagaccaaggctccaagaatatataatggagaaaagacagtcacttcaataaatagcattgggtaaactggctatccatatgtggaagaatggaactagagatctagacccctatctctcaccatacacaaaaaatcaaatcaaaatggattaaagacttaaatataggacctgaaactatgagactattacaacaaagtttggggaaattctcaaggacactgatctaggcaaagattctttgagtaagacctcaaaagcacagtcaaccaaaagcaaaaatggacaaatggtattgtgtcaagctaaaaagctcctgtacaacaaagaaacaattaacaaaatgaagagacaacccaaagaatgggggaaaataccacaaactattcatccaaaaagggattaataatcagaatacataaaaagctcagacaactctatagcaaataataataataatctgatttttaaatgggcaaaagagttaattaaacatttctcagaagacatacgaatggccaacagatatatgaaaaggtgctcaatatcactaatgatcatcagggaaatgcaaattaaaaccacaatgagataccatctcaccccagttaaaatggcttttatcaaaaataccagcaataatggatactggcaaggatatggagaaaggggaacacttgtaccctgttggtgggaatgtaaattagtacagccactatggaaaagtgtatggaggttctctaagaaactacaaataaaactactgtatgatccagcaattccacttctaggtgtaatatccaaaagaaaagaagtcaatacctctcagaaatatttgcacccccatgtttactgcagcactattcacaatagccaaaatatgaaatcaacctaagtgttcatcaatggatgaataaagacaatttggaatatatacacaacaaaacgttattcggccataaaaaagaatgaaatcctgtcattttcagcaacatgggtggaactgcaagtcataatgtcaagaaaaataagccaggcacacaaagacaaatatcacatgttctcattcatacataggagctaaaaaagtggatcttaagaagatgaagagtagatggtggatactagaggcagggaagtagggagacaaatagagattgattaatggatacaaatatacagttgatagaaaaaataagacagtggtcaatagatcagcaggggacaatagtttacaataatctattgtgtatttctaaatagctagaggaaaataatttaaataattttagcataaagaaaagacaaattaaataatggatatcccaattacactgatttgatctttaaaaattatataaatatattaaatcatcacatgtaaccccaaaatatgtacatctattatgcatcaataaacaggaaaattaaacaaaaaaagaagacctaaataaaaattgagaataatgtctttagtaatcctgatattcaatatctttaaattaaattctatatcaaggtaacagcagttaaaatcaagatgaatttttaatgaaaaatttgataaagttatgtgaagcagtaaagagccaaaaataactgagacaattttgaagcaagcatacacggtgaagagacttgcccaataaaatcaagatttattataaagctataatcaattaaagatgcatggtattcatgcaaggaaatacaaattaaccaactgagcaaactaaacactccagaagtagatcaacgcatatctggaaactttgcaatgacagaaataacgtggcatatcaaggggtaatgatggtactgagaacaaaaaggggagtaggggagaagggggattgaattcccacttcaaccatatgcaaaaccaatctcagataatgtacatctcttagatttaaaaggccaactataaaagcctcagagcaaaacatgaagaaaatcttgatgagcttggtccagggaaagattatctgagtgatgcaaaaagcagtaaagattaagaataaatttgaaactattttacttcattaaaacacatcatacctctttaaaacagaaacacaccataagtgtaacaactgggaaaagatcgaacaactgggaaacacatcgaagacacagaggattggtatccagaatacataaagaactcctacaagtcagtaagaaaaacacaacccgataggaaaacaggcaaatgccaccagcaagcagaagacacagagagggatacacatgaatgataagtgagcagaggaaagcattcccagtctcactcataattatggagatgcaaatcaagcccacagtgagaaatcactttgtatgaattatgctggcagaggtgaagaagcttgacaatagaaagtgtgggcaaggatattaatcagtagcaactctattgctggagagagagtaaattggcagaatcatattttaaaacaatttggtcttattatgatatagaacattgacattccttccagcaatttcactcattgatctatcctgaagaggaatttgcgctcatgtgcaccaggagactattcataccatgaggcatttcattagagattattacagggattatgagaagaattcatcgcatcattaggtgaaaaaaggcaccaaaggttttgtcttggatgacaatctctaagaatgcaaatattttgtggtacatttaagtaaagcagtgactgggaaaatattctagtctattatttgcacagataagggacatctttatttgctctcccccataggaccctatatcctcatactggataaacagaaagctaaactttctggagttgtcagcttagtacctttgcaattcaacttttacatttaaaaaaatacaacattatgttaaaagaaattatcccataaaatgtacatgtgaaggagagagagtgagttaagatattgggggaaaagtgaaaattttaagtttcatgatattcacagtggctccagagatctcggagcagccagtgaacaacccaactaagtttaattttagcttcttgagggcataataacgcttattatctcgaagaagagatgaggaaagaggagagaggatgggacagtgtctgctagaggtattgcttgaagtgaggagaagtggggaagtaagtagcagcattatgcatcattcccaaaccacgtgaaagcaatggagccaggtgaccagggctttttttttccctgcctctgaccttattttacaaaagaaaacaggcccagcacagtggctcacacctgtaatcccagcattttgggaggccaaggcaggcagatggcttcagcccgggagtttgagaccagcctgggcaacatggctaaacccagtttccacaaaaactacaaaagtcaaccaggcatggtagtgtctgcctgtagtcccagctactggggaggctgaggtgggaggatcacttgagtgtgggaggtcaaggctgcagtgagctatgatcataccactgcactccagcccgggcaacaggaagagcatgtctcaaaaaaaagaaaaaagaaaatactctgtgatgttgagaagcttgaaatctacagtttcacaagactacatcttcttaaaaagagatggggacgtccccttattaattaaacatattgtgatctaactagtctccaaatataacttaataaacttgaaagtaaaaatatgtgtagcaaagtgtatacgtattagagatcataaaattatgcatgagaataatacaatttttaaggtagtggttacctctgaagtttttggaaaagcgggtgctagaactctaacttctaggttacgtgcatacatgcctgggaaggaaggaagacaggaagggatgaagggaggaagggaggaaggagaggatgatatcagatggagaaagaaacagaaatgatgagatgtctactgataagaaaagtaaagttcaggtgaaggctgagagatattttatagtgacctgactcttagtaatcgtaactgctttataatccagttatgtgtcttggtttcctaacaattaacagcaaagaaccccttcagtgggtttttacaaccaatgtaataaaatgattaataaaagacagttccacctagaaaactgaacggtataaacatttatccatctcctctctaaaattccctcagtatcattccctgctccctaaatattccaacagtatttgcttatattttagtacaaaagagtttgttgcctttatcaactcagtaatttcatgtgtcccattctttaaggcataatgaaataactacattggacacattgagaaaaagttttgcattgtcgtatgaatatatcagcattttgcaatattagtatccaaaatgattgaaaatagtttgcttaaaaatgtaactttttaaattggagattctcctcctttaaatataagtatacttgcaattaatatatcttctccatattttttaactttgaggataaccaaatagtttaaatgtagtaattggatattccttgaccttcgtacattgacgtacccctccacatccggattcttctctcttcttttactctccaggtgctccacatgatgcaaggcctggtccaagtccccacacccacctcagactgaaataacctttttgtgatcagaaggctaattagtatgtattacaactattacacatttggtcttaggcatgtgctgcatagagataccctttctgctgtcatcttcaactactatataattctggtgggttttaattttagtgttcatatctcatcttcctcaatacacatgattctgaaatgcatagtcttcttaattggctctgaactggaaaaaagttatgtctttctctcagttccttaggtaaatgatgtataattccattggctttcacttttacactattaagcagttcttattagtaacctactaaatatattaagtgtaactaagattttgtattcataaaccaaaattggtatattgttggacttatcgaagactctaattcaacattcttttaaaaacattgactgccacgtggcagttggcaatattttcaacaagtatgagaatttcaatgattctagagaaagctttgttattatgttattaatgttgtcttaagtaaatgttttttctgctactttaaattattcattatatatcattataaatacatcactacctatttagatttttatgactttaaaattaattaatctcacaaaaagttgtgttatgtatttctattaacaggactttaattactcacacctctaaattattcatactcagtttctggaacaagtgtacacgtaatgccatctccttttccaaatttttttgggatggagacactgatcgtatatcctgtgaatgtgtactgttctaatatcttccaatatactgtcaaagtgagcataatgaaaatattgggctatgtataatttttaggcctaatttatatataaaacatgcatgtaagcacacttgcttttctcatcaagatataaaaaagattcctatatatttatagcaacaaatgtacaacaatttgttcttcttcaatactccactgcccataggcctatttttcactagaaagcacgaaagatcttctgttctaaggtggaaatgactgaaaaagttcgaaagccctgtataccaaactaccagaagtgactatactttaggtcagggactaagcataatttgctttccctataatatcgaaaaacataccctggatctcattaggttctccatggaatggtgttggagattcagtttgatcccacacattgaaacagcacctgtccatgtattatttctattaataaatgaattctagtttgaaagactgagaatcaagtaaagtttttttacagttacaaatgcacttttatggtaaaactaaattttgatagacatttttggttaggtgagatatggcaaataaatgtagcagtttaattttctccatagaaatgagaagtaacaattgtttcagtcatctttatttgcaccgttaagattatttatatattctaaatttatactatatgtatatcctaagagatttaggcagagtattttacaagaagaaaaagcttcatatttaaaacataaaatctggccgggcgcggtggctcacgcctgtaatcccagcacttcgggaggctgaggcgggcggatcacgaggtcaggagatcgagaccatcctggctaacacggtgaaaccccgtctctactaaaaatacaaaaattagccgggcgtggtggcgggcgcctgtagtcccagctactcgggaggctgaggcaggagaatggcgggaacccgggaggcggagcttgcggtgagcagagatcacagcaccgcactccagcctgggcgacagcgagactccatctccaaaacataaaaataaaaaaataaataaaatccctggttttacacgtgccaaagtcatagacctacttaggacttggagtaaaagagaagtggttcatacgtttattcactcacaaagtgggtagctgagacatcataaggtcttcaggttagtttttatctttaaatgaaaatgagagaaagtaaagaagaagttcatttctactctggcgtgttttaccaatgaatgcttattggcttcattaaaatccttcattgtagcgtttctcaaactctggtatgtttgagaatcacttggacatcttgtaaatacagatccctgagtttcagccccagaaattgagaaggtcttaggtggggacccaaatgtgcccttctaacgagttcccaggtgatgctgatgcttctcatcaaaggaccagacataagtagcatttcaagtccgctgacaagcaagatgtcataaaacatagatgttatgtaagaaacacgaaaagccttggccatgcagagcaagatggtgattacttactagtgattgctgttatccacgatactagtaccggccgggcgcggtggctcccgcctgtcatcccagcacttcgggaggccgaggcgggcggatcacgagctcaggagatgaagactatcctggctaacacggtgaaaccccgtctctactaaaaatacaaaaaattagccgggcgtggtggcggcgcctgcagtcccagctactcgggaggctgaggcgggagaatggcgggaacccggggggcggagcttgcagtgagccaagatggcgccaccgccctccagcctgggcgacagagccagactccgtctcaaataaataaaaaataaataaatagatagatagataaataaaaatactagtactgtgtaacccaaaagtaaaagataattatttattggtgcataaaatagtaagaaccagaaagaacgtaggccagttctcatttgagaatctgatgttactgagattaagtttttctacccacacacttttaatgtgtgtcattaagtatttaataactgcaatagctatctggaggcagaacatgtcacacatcctctatgatggtataaactagaagtagagagtcagaacttcggccagattttactgacaatttggtcaatgtggtagtttttagaatttaacaatgcttttttcaaaagaaaaggaaaaatcaatactctgaataacaaacagttggccctggcatctatttcacatttttcctggaaaatggcaccaattccccaatgttatgttagggctttgttttaagatttgtagatagaaggaaagagtgccacctgctgaggaagcccagtgcttactccagcacagtggacacagcgtggccgccctgacttaaccttcttagcaccttgaaaaaaaaaaaaaggtgtaaatctatccataaggcaggaagaacaaaacgcccagaagaaattgtcagttggatctagacctttcaaaactaaaggactctaatttgtccatgtcttcaaatcattttagagtatttatgagttataattacacagggatattgggatgccccatctattgaatctaagactatatgaaagacaaaaactgtgatcaagttcttctgaatctgtagaagcaagctgagagaaagcaccttagaaatatgaaatcattgttattttattcaaaattgcaaaatgacctagtctctccaaccaggttggttttttttttaattttctattcaaatttaaccaattcagcctctcaaatctttcaaatcattaattgaattaatttgtaggatttagcacaaaaaatgccttgcctaaaaatctgcttcaatatatatcaaagataggttaaaatatctttcaagatcacagattatggaactattgcatgggttaatatcaaatatttgccctttactagctatgtggccttaaatggttatttgtaccttggtgtgctaagtggtgaaatatagatggtaagatcatagaattattttgagaaaaatgagatgataaagcaatatgcaagtaccataagtaaatgctcaataaatataagttgccactaacatttattattattaaaagttatgaaaaataaccctgaagaaattcttacgagcacagagctaaatagctggacaactgaaagtcaaattcaagtataattcagttttggaaatagaataaaattttaaaatcttttctctacattacataaaaagttattaatattaaagggaataacttttgcataaaaactttgcagatatgttatcaatcaagttggagaaactattcatcatttaacatgtttattttatgtggtcaaaaattaacatgatttaataggaaactaaagtattagtttcccaaaaacttcttgcacaggagtgcttcttcttttcaaacactgaagtcaaactggatgacctaaataatattttttgcttgaatttcatgtgcgcttagcttatagggttttttccttttgctttgttttaaattaaattatactatacaatattctagcctgttaaactgatgagatttcaggggcaaattcatttgataagttataagaattactttattatttcatacaaaatcatattcagagataggcagataatttcaaaatagaagttctaggcttcaacgtaaataactgctgtctgccaacaatccatgtgctttccataaaacaagaccaagagataaatgtgacagcaattaagatatttattagattttaggttacactatgtgaatcactgaaccttctaattgatttattctttgttgcctataacttactttaacatacttcagcacaggctgtgcgtgtgtgtgtgtgtgtgtgtgtgtgtgtgtgtgtgtgtgtgtgtgttttcttctgaacctagaggtagttatccaaatgagaaatatagtcaccaggtgtttagctaatatttaaaaggcctcatccagtcaaaagttacacaccagaggtagacagctataagcagtattttacatcccctcaccatattaattagcattaagggtgtcagtggtggcctttcgttggttaaactggtagaattcaacttaagtggattgtctggaacattgtagagatattctcacccttgtatgaacatggtataaggatctagacatatcagtgttctacactatgaacaatgccctaagggtcatgcataaatgctgatctcgagagtttttgttaccccactgtgaccagatgattaaactatccctgccttgagaagactgttataaacatgatatcatgcaaggagtagatggaacatttaaatggacagagagctaggatttcactgaccttacagaaaaagtcaacagtgtcctattcttacttggatatacaacgtaagaatatcttttatctatcttacaatttgtaaagtcctttaatctggataatctgacttgcttttcatagtcatctaatgaggacagtcaaaagattataaagttgctaatttctaagaggaaactaagtaactgtttgagttgcctacatggcagaactcggtcttctattgaagttttctgaatctgccccagggttcttgatccattacgtgtgaactggtgttgaaataccttcaggacttgtatgctcatgttgctgtggagctagccataattccagctcgttgtattcattaaagaaagaaattatcgtcccttatttcaatgcgagactctgttctgtttctgagtggactggatgattttctggcttaataatattacttctatgtaaattctgtttacattggtagagttaaaagtatagatatgactacaaataatttaataagtcaaaccatcaaagttgtatttattattctgtgtatagaataatacatgaccctgcaactgtcatctgatgattgttcagctggaaaaaaatgggtactattgataaaaaaaaatacatcactctttggatgtttttacctgtgagattaacctttgttaaatatgggagtatttgtttttaatgagagtgttctgtgtgtctactggtgtagaacctttatgctaaggtcatgaggaataacataatgaaatgtctaaaacactattatgtgtgccaattccactcatcgcctatagaaatatttgttttaatgtatcaaaatgctgtttttctcctgttaataaatagttatatctactattttattcctagaggtttttaacgcttttcatatagctatgaagtctcttaaaagatggatcacaaaaaagagtgtccctgaagtccactgtttaactgaaacttttttgtttttttttaaatcaggtagaaacctgaataatttctcaacttatccttttctctcattacctgactgcctaccaacaagaaaataaaaggatttcatttagaaatgtaaaaagacagttaatattcagacttctaataacttgggaagcatgttgttatatacagcaaatggcttcacctctcagagcccaagtttctttatttcctcatgttatttgaatctcaatctcattcatccttataattggatttttttctctctctctctttttccttgggcaatctcttgtggaaaaaaaacaaacaaaaaaatgggaatacagttgctaataaaggccatgtgagggcaggccttctgtgtcccaaactaagaactcctgacacagagacagcctagcctaatggatgtgagctgcctgggtttcattccctgctgcaccactcaccatccgagtgaccttgggcccgatattttaaaccctctgtacttccattttgtcatcaatagcaagaatacaacaataacatttactttatagaaatgactctcagataaaatgtaaaacaaaaaacacatcactagttacatacagtgcttagaacaaatatctcgcacatactaagtatttaattaatgttagcgagtaatactatcatcatcacttttctactgctgaattttctggttttaataactttattttcgaaaccatccatgatatggcctattttggcaccactgggagtgctgccatcttctcaaatagaaagcaattgagaacaattcagaataaattagacctctgaagatatgtcagccccttcacaggagactcattttcaaaacctgctacctctagggcactgctgccagggaaggaggcattctgtgaaaatctatttgttttcacatttttattttcttttaaactgtctactcaaatattaaggagaattttgtgcaaacaccatcaatttaatgggtcaagttcattacgagatggaaagtacttcagctgctggaaaagcatgaatttcttcactcagtttttgccagcacagtgtggcataaatgactgcactgattgcaaaagctctggtatccagctacctgggttcaaaccttggcttttctgctttccaactgagtcacctcagttttctcatctggaaaattgggataacagtagcagttacctctcttcagggttattgtgagggcggggtgtgagaaaagcacctagcatgggacctagaatatagcaagtcatcaacatttggtggctctggttatgtaaagaatgcttatactgtactaaatctcggtgagaaccaatgattcacaattagtggaatacaccagatcactgtgctggagagatgggatggccttgagacattctatcatcaaattcgtttatagatttaaaaaaggaaaaaaaaagtcttaagaactgagatgagtcgcccaaggactgcagtgattgtagtttgaccacaagtgaaaggattcccacctattccattacagtgttgtttgcgtgaacacatgcaggttgtgtatgtgtgatgcaccagtactgatttatgttaagctgacttagactgccatgcagggcctagattatgggagtgaacaaatattagacaaaaactaactgaagaacataagagaagagagatctgaatttccaatatagttgtctttctgatttcaaaaatcagaaacttgtccccagattttgtgtacgttcatttctatgatgagtttccaaaaactgcaagagtcaaaatagggttgtcatgcatggatagttggtggaaggttccaagattccgtaactagactttaatgaaaagaaaatttagattttctacactgcctttaaattttaaaaggatggagcaaaagaacactctagatctatgctgtccaatatggaagctactagccatgtgtgctcatttaaatttaactttaaatgaattaaattttttaaaattagcaagtaaattcctcagtgtactagccacatttccagtattcactatccacacgtggctagtggctgccatgctggacagggcagatggacattcccatctttacagaaagtccttttggaagggtgctactgtagatcatttgagaaatcctcacaattatagttagtagtgtaggctgcacaatggccacaagtaccatggaaagtattttcatgaaatgcaaagatgtgcttgcacggatgataagaaattggcctagactctttagagaatttagtcaaatccaaggcatttactatgcaatgaagagtctataatttgtgacgtgggaaagatctccaagaagggaaaaaaaaaaccctgcagactttaaagcggggggaaaaagactaaacattcaaataattctgatggaggctcacctgattttctaatttatttataagcatctttgaagtgtttttcactttcagagtcacaacaggggcttttccaatcaatatttatgttacttacattacacttggaaaacaggtaacactttcaaatgctgatatatatggaagaagattgcgttggctcaagactgagtctattcatggaaaacgtccatgttgatataaaaaattctatcattcaccatgatgaattttaaacagaagatacatttttatctacttagattttattttggcagtaaaatatctaatgattattcaattttatctgaagtataaaatatcattaggaaccctgcctgcataaagtgctttaaaatttaatcttaacactgccaactgctctttgccatggattgaactaattaataccagtagtttccaactttgaagtcaggaaggaagaattggtattttgccctcacaactctaatctttgacaataatgataatccttatatctgaattgtgttttagaatgcaaaatgctttcaggcaaagtgttttcacataaaatagctcacttgctcttgaaacagtcacttgaaacagacaggggagtttttaacattcttaacttagaaacagggaaactggtgtttatggaattaagtaatgcgtcccaaagactcacagtggcgagcggaaatcaagtcttaatttagtgttatttccgctatgctctgctgccttcctgagcatcttgtaacctgctccagttgctaccaccagatttcataccagactgggaaggagagtaaagaggaagggaaaagagaaagaagagaggaaatgggggaaaatgacagacaagagacaatttatgtccttaaaaataattggcactgagtcattagtaccaaatgtaacacgttaccctggatgggttcctgaaatggagaaaagggcattaggtaaaaattaaggaaatctaataaactataggttttagttaataagtatgtgttaatattggttaatgaataataacaagtgaactatatgatgtaagatgttaataatagggaaaactgggtgtaggatatgtgggaactctcagtactacctttgcaaatttttttatgtcaatctaaaactcttctattagattggtgcaaaagtcattgtggtttttgccattattttttttaaaaataacaagtttattttaaaacacagttaggaggaggaatatcccagatccctcaaggtttacagtgcctcgtgttgctctgttgcagttggctcactgttttgatgatggggagtttccagcccaatgtatgatgcttgtttgatgatactgtagaagagatgtgtcaaactatgacctgcgggccaaattcagcccagctcctttttttataaatgaaattgtattggaacacagccatgctcattcatttacatattatccctggctgcttttgcactaccactagcagaggtaattataagagaagcctaaaacatttgctatccaaacctttacagagaagtttgctgaacacttgtatacaacatcacattttctgttttccttcaacagctactaaccgagtgcctaccatgtgcccagcattattctatgtggtggtgatagtggtcatcaagacaaagactctgcctgctctgcaacttgccttcaagaaaaatgagatcatagaaataagcagttccatcaatgaatcatgcaagattgtatccaatagctctaaacactacaaagaaaataaaaggaacataattgataatagagagtgatactgggagctaaggcggcttagagttggcacacaagtaaggcctctctgagatgaatcctaaatgatgagaatgaatccactatgtaaagataaagggaacaacattccaggtagacggcctagaagcacagcacagaagtcataagacagaaaccgatttcaaggctaaatccaggacatttttttttttttttttttgagacagagtctcactctgttgcccaggctggagtgcagtggtgcaatcttggctcgctgaaacctctgcctcctgggttcaagcaatcctcctgcatcagcctcccgaatagctgggactacaggcacgcaccaccgcgccccgctaatttttgtatttttagtgattcgtccaccttggactcccaaagtgttggaattacaggcgtaagccaccatgcccagcctagatcaagaaaatcgtaagacttttctaaacttccaaaattaaatatataaaaaaaaaatccacatctcttattcctatgtatgtatgtatttatttattgctgcaaagtttttgagagttttttcaaagggaataaccaagatcttcatattccattgggactttgctaataaaattggttattattttaagtacattccccatgggaaaagggcagcactaattctcatttatcacaagattatatggtatgttatgtttccttttaagtcttaaaacaatgtcctccctatttgtgctaaagaaaagaagcttcaaggccaggcactggggctcatgcctgtaatcccagcactttgggaggtcaaggcaggcagatcacttgggcccaggagttcaagattagcctggtcaacatggcaaaaagcttcaaaagcatgactaagttgtaacatatatgactatgttgtaacatatatgacatatatgactatgttgtaacaaaatatctctggaactttcttatctctataactgcaactttatactcattaaacaataacttcccatgtgcagttttttgtacatcaattatactttaataaagctggggaagggggacatttgactactaatataccaacttagaatctgttctctttcaccactggacatggagaggaagaagctagaatgtcccagagtattatctgtcagacagtagttctaaatgatgttattaggtgtatgtggaaaaattattatgttcaaatgaagcttctttactataggatgtctgaggggccttcgtaagtgaacataaattgtgaagtgacaagctgaagcttttaaggcataggaaacacctaatgggcaagggccctggagaatactcttgcttttgagacataatttgctgctttggataatcaaatgaattctgatattcttcttactttggttttatacatatgtgtgtgtgtgtgtgtgtgtgtgtgtgtgtgtacgtgggtgtgggtgtgtgttatagaaatatatttggtgatatatatatcatcaaatatgttatatacagtatcatataaaatttgagataacttatttgctaaaataaacctgttcctttaatgtgcaaaaaaagggggaaagtcaccaggaaggcttcttaaaaaacactgatccttggactctactcctggcgtttctgactcagtagctgtgggtgggggctgagaatctgtgtttctaacaaatcccccccatgctgctgctcggggactacactttgaggaccactgatctagatgttcatttcaatttttttgggtcctagtaatatacacaattgaaagtaacaggaattactaggagttgtgatgcgttaacaatttcagcatctcaatttctttagtaagagtttcatttccctatataaaatgttaatgaccagagtatgcatttgttgctttaaattaaccatatgagaggtagtgtgaaagacgcacacgaaaacagaggcggccagtgacattaaagggccagcaccctcacatcaggtacacaatctcactcatttttttttttccttagacatcttcacttatggtccattgaggccttcagtgttactacaggtaaaggtgatgtcaagtcctgcccagccaccctcacctgtagaacacacactgtgctgctggagttcagagaggaaagtggctttttgccccatcaccccaaccccagccaacagaagcgttcagcagtcaggctcattttctcttattctgttctttgtgctgagttaccatctgctgctatcccaatcattttatatatatatatatatatatatatatatatatatatatatatacacacacacacacacacacacttatacacacatatatacacacacacatcatatacttatacatatgtatatacatatacagtcatacattgcctaacaatgaggatactttctgagaaatgcctcattaggcaattttgtcattgtatgaacaatacttacataaatacttacataatacttacataaatacttacatacaatacttacataaatctggttggtatagactatgcacacctaggctgtacagtatagcccatggttcctaggctgcaaacctgtacagcatgttactggactaaatactgtaggcaactgtaacacaatggtaagtatccatatatctaaacatatctaaagatagaaaaggtacagtaacaatacagtataaaagactttgtagatggtacacatgtacagggcacttaccaagaatgaagcttgcaggaatggaggttgctctgggagagtgagtgagagagtgagtggctgactgaatgtgcagcctaggacattatggtgcactcttgcagattttataaacactgtacactagtctgcatcgtttatttctaaaatatttttctttcttccataataaattaaccttagcttactgtaactttttgactttataaacttttgaatgtttttaactttttgactcttttgtaaaacacttagcttaaaacaaacactctgtacagctgtacaaagatattttctttataatccttactctataagcttttttctatttttaaatttttaaatttttactttatactttttaaactttttgattaaaaaaaaactaaaacacaaacacacgccagcctaggcctacccagggtcaggatcgtcaatatcagtgtcttccacttccacatcctatcccactggaaggtcttcagggacagtaacacacatggagctgtcatctcctattagaacaatgccttcttctagaatacctcctgaggacctgcttgaggctgttttacacttaccttatttattttctgtaagtagaaagagtatactctaaaataaggttaaaatgtatagtatagtaaatacctaaacaataacttagtcatttataatcatatcaagaattatgtaccgcacctaattgtatgtgctgtttttatatgactggcagcacaataggtttgtaaacagcatcaccacacacatgtcagtaatgtgttgtgttgtgttgtgacatcataggacagctataatgtcactaggcaataggaatttttcagtcccattataatcttaggagactaccatgatatatgctatatattgactgaaacattactatgcagtacatgaccatatatatatattcctgatgttaaagaacaactcttcctcacttaagaatatttttaaaataccgaagagtacaagcaaaccaaaacataaactcacaaattaaaatcatccctattcccaaagccagaaataatcacaattaacattttggtgtattcacttctaattgttttttatctgaaatatatgttaaattgaaatgtttttatgtttattggtcatttccatttcttccagaaattgctctttgttgtctttcaatatttttccattattttcaactaattttttccattagggtattactgtatttaccctaatttaaaaattaaattaggtaaattatccaacttacttacaatttgccaatacgcaaccatgttgacttgcaaaaaaagtgatataatttttagcttttaattctgcttgtaatgttcagaaatcttcaattttcacagagttaaatacctctaattttttctttgttattttcccccagtgtttcagtaattagtctaaccatccaaggtcatttaaatgttcatgtttttgttctttgttttattatatcactttaataccttgccaaatacatccatccagtgaacattaacttgacagttttatcaaaatgtattttttccttcccatcatttattgagtattctatatatttccagtttgttatacttgctttaggacataatattatgaattaaaatcttatatagcttattaaggtcatattcatataaacgcttatttcatttatgtgccattgcatttgtttttataacatgtgcctagcacaatgccattttaattatgaaagctttataaaactgtatttcatcaattctaagatgcacaatttttcatatactaacattttctgaaagggaatgattcttagcatgacagaaaattacagttttttttttcttttcagtggttgataaaacaatggtttatattacaatccatgattcttctattcatcgaaatacataatgctttaatacttggtgggacaaagtttcttttattatttcttgtcagtttagatttattttatttacatttttattcttttttcttttctatagatttttcagaagtttatttatcttttttcatctcatctaacgctttcgaattctactttatctgaaacagtttaccgccaccttgtttttgtctgtgttgctaaattgtttttattctttaatttttaatattttatcataattgtatcttcattatttttctctgttgtggtttatatacttatatatgggattgcaagccaaatccagttgtatttatcttctaatagaagagtttaatcctttcatcctttcgtacttattttcataagtgacttttgtttcatacgttctggaatttgcctgtttctgtctttttctatagaaaaagactttctaatctttagggatttggaagtaatttctccagttttaaaattttaaatagttgctgtttgtattttcattatattattatctgtgaacaaaaggcaaccaattcaaccaacttgtatttctttgcctgcttaaaacctactcctgttcatctgacatttggttttaggcctaaattattacactaaaaatttcatttcatctactagttttgacagaacatttgaaataattatttaagtaatttcaaaattcattaaatctcttagattgtaattttcctcattctagagttctaaaattttactcatttctcagccgtattatgtatttaaatttattttaaagctagacatacacagcatacatttttaagtacttccatatctgagactgtccccctgttgccttcatacatggaggaatatttggcttacaatttttaggtctcaaattcaccacatgaaaattctaaagatactgttcaattgtcttcattcaattaataatgcagtggagaagtctgaggccaattcaggttgttcctctattggtaacctgcttctttgcctgaatgcttttaagaatgcttccattaattttcctaattagattcttgccctggttgggtccttttagttttactttctgcagatattctggagcatttttatttttaggctcatagtttaatcaattgtggaagttttaatcagttctttgttaaatgatagcttccattccaattgttctggtttcttctttgggaaaaccacagacactcattttagatttccattctccacctgccgtatacttcactttttctggaagagtgtttttttgttttaatcactttgcctttctcctttgttttcaggaatgacatctcaattttgtgctacacatgaatggttttatttgctgcaatagtcgttcttatctttactgcctccattgcaaattttaattacgcttttgcaatttgatttactatatctactatcttaccttgatcggctttttaacttctccgcctttggtctatatgtcttgttttattgtcggcccattctccctttgttttgtatctgatcccatttgttttccatacttgctgctcacatatgcatagataccatcttttgttgcatatagtgtttaactcaagatggaatattttaacgttttcttctggttcctttaataaatcattgttttaaatgctttttaaaagatccttcaaaatgattttctagtttccctttccctgtatggcaattaaattttaatcggacacatgttgttttattttccctcttgtataagtggagacccatcctatttacagcatttatcaattagcaggatgcccttggccctagctactgtccatttgattataaatttaatcttcgtctcagatctatatttgaaaagcaaattgatgtgcatagttcttggcccaattcccagggtcttttctgttggaattaaaagagatgcctttcctcccacactctggagttcttaccctggaaattaatgcagtacaggaaaatctactgcatgtattgctcccgtgtcttttctacttccttgctacaggaaaggagactgggattacatataaaagcaacaagtatatgttataatgagagagaaaagggatggtggctctctaagaccctaggatttaggtacagggaacagactgcgtaggaaagaaaaagaaaaggcgtaaaagaagagaacagggacctacggaaaacaaagtgccttcctatcttttttcagtagtatgaggctactctctttcatgaaacctccattttttttctctcaatccaattccatcagcttatagttagtggaaattcctcccattttctagcaataggctctgttggtcttaaatttttgtgatgttgtgagttttcctgtgccttaatagctattttagagggaagatggtagagactgccttagggacaactagccagatgccattttaaactggagcctatggattagttataaacacagagaaaacaattgtccatgccataatataacatcattgttgattctatccattctgggttgatgtgagccataaaagttctgtttgttttcagggtcaaatactgagcaacaggaattacgctaacaactttattctgaatataaatttctaaaaatcaacttttgcatggatttaagatacttttgtctgttatgttggctagaataatactgactggaacttgatatttttgtttactaaattaagattgtaaaaactcatgttacttgcttagatattgatttttttaaagctcattatgtcaaaacacttgatttcgttccactttagaattatcttccacacatttaaagattcaccaaggtagtggttctaaaaccatactgtgaataattttctcaggaggagctcataaaaatattcagatccccaggcaatgcctctgcatgtatagactgagtaggaccagagatttttgtttgcaatgagtacacgcaaatgatactaaagcagtggtccagtcatactttgaaaaatgttgatgagtttcaggagagtggttaggacttttctatttttattggtgttcgtatactatagtctcagagacatgtaattatatatctcctacagtgaagactttctgccttaaacagtgaagactttctgcctttaaactagatttttattgttgttaccacatgtaagaacaatatgactatcgcttcaagaatttgtgaaaacatgctcagctatctactggttggctaagagatttaatgcaatttgttctaatagaaaaaaaatctttacataatattccccaaatgagtattattaactatcaagattaagcatataaatatgttaattatctggcaaacagaaaatgcataattaggtaggaagggtaggaattttagagttagaataactaagttaagatccatctatgtaaccttgaacccattatccgatcaaagtctccatttcttcctctgtctaataaggctaatcccatcctcttgactaactcaacaggttttagaaaggtcaaatgatacatacatacatgtgtaaatgctttgtgagctgttagcactgcaaacattaaaaatactgtgcttggccaggcatggtggagcactcctataatcccagctacttgggaggttgaggcgcaagaatcacctgaacctgggaggttgcagcgagctgagatccctccactgcattccagcctaggcacagagaaagactccatctcaaaaaaaaaaaaaaaaaaaaaaaaaaaaaaatatatatatatatatatacacatataatgctaaatgaaaagtactttatctccacacctacacagcatcagcgaaagtttcagcagttctgtcatttcactgaaaaccaaataatcaacatagatttactgaagattataccaagaattaaaactaggtatccaatatataagaaagaaatgtctttgcttttctactttgcagttaaatatattggtatttaatagttcaaaagtatatgatgagtttttctaaaaccattaaaattgagtgctgctgtttctcagataggataaattcattagtctaatagagtgctacaggtaacagttaccccttggtaatttttccactaatattcatgcactgtatttcagtctttcaatactactttaatgacttgtagacttttactcaggtacttcctaattaagtgtatttgtaatagctatagtttttattatcaaatcattctggattcagactttaggctgatagttgtttcttaattgctcaaatttttttaagtttaattagttttagatggcagaacagatggtctgtgaatccattggtgctgtatctatgtgataatatactttggttctgtctaatggagtgactcttcttttctaaatattctcatttaaacagcactcttagtttctcactttttttcaatttgtgtcaaggataatgtgaaataaacatgaattttatcaaattgttataatcttggccaaattcggaatcaaatatgacagctttaattttgatatatttagattcataaattatgattatgcacacctaataaacattaactcagtacaaaaggaatcttatctccaccaatattataaaataaaacaatttcctaacaaattttggtaagcacctaatggatgctggactctggggctaaatcatgaatcaaaataaacagtgatgcggggcaaatgcctatagtcccagctactcaggaggctgagatgacaggatcacttgaggccaggagttagagatcagcctgggcaacagagtgagtccccctgattctaaaaacaaacaaagttccctttctcctttgctctcaaggagcttatagtctatcggggtgaaggtggatgttaaactaatcatcacgctgctgatgacataattacaaactataataaagggtctgaaggaaaaaagtataatcgcatgagcaaagaagcctaagcagtaattgagggtcagagaagacttcttcaacgagcagcctttaagccgagacttgggtagtgaaatcaataaactcaattagtgaagaagaagagaaagaatgttctagacacagaaggcacagcacatgtggagaatatactgcaagagcacacggtaaataaagcaaggccagagtggctgaagcagagaaagtaaggggaagaattctatgaggtagggcttgagagactgaaatagccagacatttccactaagagtaaaaattttagcattatctaaagagtatagcaaagctattagagtattttaacagagggataatattaccatgattgcttgtgaaaagataacttagttgatttcaacatgcaaattgagctaagctgataatgcctatcactacaaacctattaaaatgttcagcaaatatgtcgggcactgtgacccatgccggtagtcccagctactctggaaactaaggcaagaagatttcttgagtccacaagtttgagtctagcctgggcaacacagtgaaaccccatctctaaaaatacaaacagatgaaaaatgttgggtaaatttacaacacaaacttctaaaaaataaaaataaaaaaacgtgtctgagcgccaataaagaagaaagatttcctgatagactcataaaaggaaaagtagctcagaaaataactttaataacagaataatttggaaaagatagtaaaatgagagtgtttaaaattataagttacaggctgaggtcaggagttcgagaccagtctggccaacatggtaaccccatttctactaaaaatacaaaaaatagccaggcgtggtggtgggcacctgtaatcccagctactagagaagctgagacaggggagttgctcaaaaccaggaggcagaggttgcagtgagccaaggtcttgccactatactccagcctgggcaacaaagagagactctgtctcaaaaaaaaacttgaaaattaaaaattaaaaaaaaaaaaaacaaaattataggttacagactcaaaattatggcaaaacaatagatcatcatgaagatataacagatttaaaaatgaatgaaatataacttctaaaattaaaaaattcaattaaaaatttaacgtcttcagcaaattatacattgtagaagagaggattttgaactagaaaatatatcagcagatctacatgtatcaaaggaagaatgtgaaatggaaaatatgacaaagacaaagaatagaataagtagagataccaaatagaaaataaagagagaaggaaaagaaaaatatttgaagagataattgcagtgaaatttctagaatgtataaaaaaggatacttacttgacaaagaacaccaaagccagattaaaacagataaaaatcaataacataacaaatatagggaaactgaagaagactaaagacaaaagatgactctgtggtttttggcttgctcaatgtggcagatggtggaaccattcagaaacacaggacaatggaaacagaggagattagggctggtaaggtcagtcttgaatctgctagattttttttggccttacagacagtcatgtggtaaagtctagtaggcaaatgaatatacagcatggatctgaaagcagaagtctgtgctagagatattggctgtcacatgagtagatgtcaaataaagttgttcatatgggcaaggctgcctaagagatggatttagataaagttaagggctttctggaactacatataatgcctgataaaagtagacacacctgcaaaagaaacatagaaggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtatcaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaagtgggatctaattaaactaaagagcttctgcacagcaaaagaaactaccatcagagtgaacaggcaacctacaaaatgggagaaaattttcgcaacctactcatctgagaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaagaaacatagaaggattgtcagaatggaaaaagaaaacccaagaagatatattcccacaaaagccaaagcaaaagaccaagagaggatttttttattctcctatatttgcagctttgaagatcatctctacatgtaataacatcatattagtctggcattcttctcctagcattaaatattaaatttagcacacattcttacatatattaccacatgtagacatagagatctttcagaataaacgagtattacagatgttcacattatttatctagagattttagtcattgttatcctctaaactagagatctgcaaatgttttccacaaagggccagagagtaagtattccaggtgttggggaccatgaggtctctgtcacaagtactcaacttttccatggtagcatgaaaccagccatagacaatacttaaataatgaggatagttgtctcccaataaaactttatttacaaaaaataagcagcaaaccagagaatctgaacacacgagagcttccggatttgctctaggacagactctgaaccatttttcacttttttattgcatataagtaatatttgcatgcacagcatttattttaattttccatatttttgttaggtgaaaaaaaatatttctttgttaccaggataaactagacaaaatattattagatgtaaactatttactaggaaaatataaatgtaattagaaaattcctaactgcaaagtatagaaagaataacaacagaatataaatagcagtgtttcagttaaggagtatgccttatatatgccaaaagggaaatgacgtagaaaatcaatctgataggagaagggaaactgtaaaagaattcatgatccacgtaatagtactaaagtgtctctttttttgaaaattcaagacattcacatgagcacttgtgaacaattctgtgggagaaagataacaagaaaggaaatatccccaaataaaactgcatgtctgtgcacacaccaacacacatagacacacacatatactactatagtttgtagctatatggaggcttaagaatttctgtagaacaatacacctcaaacttaaaagaaaaataatggttatatattatttaaaaatatatttttaaatgtatctgaagaaaaaacaagagtttcactcttgttgcccaggctggagtgcaatggtgcgatctgggctcactccaacctctacctcccgggttgaagcaattatcctgcctcagcctcccaagtagctgggattacaggcatgcgccaccatgcccggctaattttgtatttttagtagagacagggtttcaccatgttgttcagtctggtctcgaactcctgaccttaggtgatccactcgcctctgcctcccaaagtgctggaattacaggcatgagccattgcaccaggccgaaaaactaaatatattaatgtatcctgttttatctccttgcagcaaccagagtacttacagcatttattaaaaacaatcttccaggaagatggaaaaaatatacacctccctattcctctcactaagtataattaatatcatgttagttatgtatataacaataacaggagactctcaagggtggagagaaggcagatgcaataggggcctcaagacccagggaacaaacacgagttttctggattttctttttgcctcatctattctagactttgggctgaagaatttggcaagctggaaacaccaagaggtgcagacaaaaaaataaaacctgtaaagccaagattttttgttctctctagccagagaaccaggaaaggggcagcttaacaagacagaaaacttttataccataactgctttactccagtcatagaaaattttttccatagaaaacaactgtgagcccacccacacaccaccagcaaagatgaagtgggtcttcctgccagactgtgagaaagcaccccaacacccatccccataccatcaccagggtggtatcagagaaggctgaaagcttggactttcatccccaccatgaagtaaaaaggcctactgctccccaacccttgtgatatcagtagagatcatatggggtctgtgactgaaatatgtgtttagtgaaaagtagaatcttgggggtttaaaactttgataattggcaaagactgatttttaaaaattcaaatgaactttctaaaattaaaatatgacttttatataataaatatatatgaaataatatttatttataatagtatcacagactatttcatattgatcttctctttactgcaatgtacctgagcaaaagagagtttttcatattgcattgggtaaaaatcatataaaaataggcctgattctgcatctaacatcggagttggattggtaacgttacatctgatatgaagtgaactactgcctcgctcttgaataatcctcaatgttttacaacccctagtacaacatcaaaatatattaagataattctttttaattcacaaaggcatggagctgtaagattccttatttatctcaaatggtacctaatttatagaagcttcagaaattacttttcccaacttaattcaggaaaatgtgtacttccccccacccccaagccccttcattggttggtctgctgaaaaaagtgccttttttttagtagaaattctcagcacaactgttaagtgaaggtagcctatagattagatttgagctccatgaaaaatacaaaaatcaaccaccaataattagcagcctcacacaagctttgtagtatctgctttgaggctcatctaattgtatctaatcccacatcagcagggttctcaagcctttacctaatgaaagattttatcataagtccatcaaaatggactgtgagagttattgttttctttctcatccttccaaatcattttaactcttcatcctttttaaaaatgacattttgctgtgttccttgacgtttgtggaaacgatgaccattagccaaactagacaatagcaagagctaaaaacaaaaccgtgtgctcagtacatatcccaggtgatatattgatttattgtagtcttaattattctgcatctatctaccgcttttcccttgcaggttttccagaaactataaaatctttataataatattttctgtggagaaaatgatttcatttaagtatgacttattacaaaaatccagtaatgttattatgcttctattttaatattttaatattttttaaaatttaataactttaattacattttatatttttaataaatacataatggattctagcatagggtaaatggacatattattgtctaaaatgggggaaaactaatttaggaagatgataatttaggaaactagttataatccaatttctagatagcaatctttaatcttataattatttttctttcaattattgcttgaagatttgccattattgtgggatattgagaccataacagtaacttagaaacaacccaagggttacagggaattcttcattactccatagtgaatactcaagttatagaaacaaaacaaaaagagtacaataaagcacaaatcaccatattacttactttgttgtgccaatacattttagaatatctagaactaagctttcagaagtacaatgacaatatgcctgaatattaaaaaatttaaaatttgattatataacagatggattccattgtttttttaaattgcagataaatttgttttgtttctcccagtggagatttttgagtatttaattaaaggcctcattgccccatcattaaattcaaagaagcatatctaatgtgaacacttaaatgtaatgtcactcattagtctttaatgaagagaaacgtattctttctctaaagaacagctgtaaaaatagtgtctgtcacctacaaaattatacattctgaagattattaatgtgcatttaatgactttgaaatatgtctttgcaacagttactatgcatgtttcttcctttcgggcttcatctgtgaaagaggttaactaaagtcagagagcctggaattctcatacacctcaggacaccagcctgaagcagaagctaaattttcccaggtacctgtaacagattgggcatggagtcatttggctttctataccacacattttctcattggtcctgtaccttgatagcagttttcataatgccttagccataaaaatctgtcattagacagttaaaattcatctggagctctttttcctaggatctagtcaacaagaaaattgattttaatgtctgtgccgtttcctgactctgcaagacaagactcagaatacagcacagtgattgcagttgattcactattgccttatcaccaccatcatcatcaccattactattatcctcaccaacatcatcacagtcaccaactgtcattcttgaaaaatgtatttatacctattatatgctgaagtcctacatcctagtatttgatcactgagccatggcagccatctaaatctactgcttttttttttttaagacaaagaaagtactgattagttctgcatacactcagcaaagcatctaggcaaatttttttaaggccatcaactatttagacctatccagatctggatatgtctggtgttagcaaattcaacgtatgtattcttcattgaactctttagattttattcaggagattcagggtcaattaggtaccactaagttatgttctgaagtatattactactttgttgaaatacaacccatcattaagcataattcgacattaagtgcctccttaaagtgcatccaacatgcctttaattacagaagcacctaaaatagttcatcgcagacatatttgcatatctaatggttccatggcataactccaagaatgacaaaatcatattatttatttattcattcagcaagtatttatctagcgtctcttgtgtcagacatagcgctgtgtgctacaggtacagtagtatacagtctcacatttgtaggtataaatacatatatttcacaagtatagtcatgtctttctgcattgggaagatgttcttcatagtctgagtacttcatattttttccttgcaacaggagtgtgaatgacaataacataaaacaagtgtgttacttctggaactattaccaacatggtagtagttccatggtctactggtggttggattatgaaagccataggccacacaagatctaacaaaggtttaaatcttgtgtggcttatggcttttataatccaaccatcttttgtaatttcaccacctgggacaagacaacacatgctgggtgcacgaaaaccctcgtagttttttttggttgaatcaaaagagtaaaaagaagtttcttcatttttaaagtaatttggatgttcaaatttttttgaaaccagttgaaaacatagtttattaaggcatttttatagctactctgtttaactttacttattaagtatttccttctttgtttttttgagacagagtttttgctcttgtcatccagcgcgatctcggctcactgcaacctctgcctcctgggtttaagcgattctcctgcctcagcctcccgagtaactgggataacaggcacccaccaccacacctggctaatttttttttgtttgttttgtttcgtttttgttttctgtttttgaagtatttcttcaatatgtactttaaatatgtactggcttgtcatgctgcgtcatccgttcaccagcatctctctctgctttcctagctccaacccatccacagaaaacaacctaatagctggaaaatagatgctttgccctatgaaacttcttctgatactttccccctgtgcaattgactgcctcctattttgtttccccagtgtatcttgttttcatctatatcaaaatatctttgtattgcatttatatatttacaagcttaacctttagaaaagccacagtctcattgtgttgtctcaataatcgttctattcaaaacataatcttacttgtaaaaataattaaaattaattcacttctctactcagtctcctgaagaaatgtcaaaaggaaaattatatttctaaaacatacagaattaaaaaaaaaaagcttttgtctcaatctttgcatacagggttgataacatcaaataaatagttgggtcaaaagtcaagttggacactctaggttgctaaagatgataagaatatagttgaaatgattgacaatggggctacacaataggaagatggttgataggaagaatacaatgcgtttgtactgtttgaagaccagacactgtgctttcacttacagccaagactttctgggtgcaaatgacagaaacttagttcaaactgacttggctatcttatataatgcctagggacagtctttaggcttggctgaatccagatgctcaaacaatgttatcgaaaattatgtgtgggcttcattctcagcaaggcttttgtcctggtcatagccactacaacccaaggcctacattcaaccagcttaacaatcccagtagaaagaaatcctctttcccaaaagtttcagcggaagttgcaggattgattcttattctccaaacttgggacacccaaactaagactctgacgggctaatgttggatcacaggagtatctaaggaggtggagatttgatcagccccatctgaactggaggactgagagtaaaagaggagtctcacacacagaaactacggggctgtcaccagaagaagggagagatgcaggctggtcacaaatgtgcacactatactcacatgaaataaaatatactgcagatggatattctgtttttacaaagattttccttctgaaatgccaaatggagccaataaaataagaagagacatcatcaactatccacagaaacttttcatatctcaaaatttcagaaattcagtttcccttcagttaccttttcatattgagtatgaattatatcttttgaaaccttagttgccctgctctattgactaaaaagagcaaataactcatgtgaattagtctttctctccatccttctgtactctgtttctctaatatgcatatagatcatatatataatgcatttcaattcttctcagagtgcctgttaagaacagtgggtatatatggtagcacttgaaagagctcagtaaatttattgaacttttcacttggtctaattcactttccatcacttgcttcctcagtgctcttccaagaatgaatgtgtgtgtacatagaatctttgcatgtgtaaacatttcccccgaacacgtgttatgtgtggaaattgctttacatttgtatgcatgtcttcctctcctgatctcttccttcatttatttccaaacacactctttacctagactctgctctgcaagcttacagattttcttgagtcgttgtcatgtgtgaatgggctgcaattcagctctgcttcttcataagctcacctttttttttcttattcccacacaatcaaacttctttagagatagtctgccctcagtgtattcgttacctctgacttcattcatttaaaaaaatcaaccttatggtctggcttttgggcccacttattctactgaggcttcagtcttattaacactgattgaaataacctaagtatagcaccttcatctccgagatcatgtaacgttgtaacaacagttacaataacaacaactgacatggataaaacacaggtgctaggcactatgctaattttctacaaggattagctcagtgtatcatttaattttcacaacatccctaagaggtaggctctatttttaatctccagaaaaaaaaatacacagaagtttgaagtgaataacccaagagtagcataaccaggctcaatctgaagtcttcttatccagtttattcagtgcctgtgtttttttcctgattctctcttagtatcccccttccaaccaactctctgagtctacccttctacagaagatgaaatcttgaaaattatcagtgataacaaatcaccaagtacaatgcttattctccatcctgacctgcctacttttgtaataacaacaaaacttcatatctattaggggaggctaataacctctgttatgtgttacctcccataacaccacaacacttggagtgcagggacaagttcttctgtatgtccggccacacccacagtgccttgcatgtagtgagtctcaatgaatgttcaccaaaggaataacgtgaatagagactttttatagtttgtcatacagcatggtagattctcgatacccaagggatgaatatttgtaaagacttcctagtcttagcattaattcttgtgtctcagcactaatttttgattcactcaacagacacaggtgtgtaatgagtgtgtcatgagtgtgtcaaagtttattttacataataagcaacttacatagtttaaaaaagatattgtaaacttcatggtatccttctgccagtattctgctgtgattaaaatagcatttggggaaatccaataaataaaattatataagattcaatgagagggaaaaacctagcaactactgtactttaaaaatgacacttagttcacaatctcttgggtaaccaatatcagaaagatttggagtatgcagtaagacttaaagtaattttgtttgtgtcagagatgtgacttattctcaagatttacctgctgtatcatttactcttactcactgatttactgtataagtttatcagttacacttaggagcttgatcttgctttctacttaaaacacactgcaagtcttaacactcggaggaaagcactctgcaatctgctgccacattttccattaatccaaaattaccttgatcttgctcagatccataagtcaaatggaagtcaagaacagaagaagaaggaaagaaatcagaaagtttcacattgagctaacttctaaaatactttgtgctttttttttttttttttggaatgttgaagttcttatagcacagtcctattcctttctactcagaccaagatcttattgagctcctacattcttgacaaacactggttccattttcatggcatcacattatatgccccattatgacacacatacctgctgtattaaaagtattaaaattcacatttgcttcagattagaattgttaaagcacaaagaaaaagaactctgtattgcaaaactatggctgaatctcaaggatgtaatattattcatgattaactgatttgcatgcagtttcatcaaagtgtatgtctttaccctaaatgtggcaagtccattttggggagagctgtcatcattgaggtaaaaataagagaaaccactttaggcatgcactgctgaataagcaagcacttgtttctcaattattccttaacaatttctacttctggttctcacactcaccttctacattagcaatatgacccatttattgatcgacagatgtgtagccagtgtgcttttgtcactgtaattgatcatctagtttctgaaatattatgactggagcaaagtattcatattatctttattaagggtttgcttaggcactgcacttgtaaatttcaagcttagttgttctagaaaagaaaaaaagtattttctatgcagccaacttaaatttttgtttgtcataacattgctgtggtgctctggtgtcctcaactatagataacacaggatatgggtgtaccgagttggcaccagttttatggatgtgtcacttagaaatcccaaagagcatgtgtccatgtctctcaatccaccagtaaaacattgagcacactgcagtatatgcacaatgtaaagatccccttatccccagatgcaatggattttttggggggaaatacaaaaagaaactcagtaacaacactaggcaatagattgttagccaatgacagggaaactgctgttggatttcataggagaaagagccagtattgcatatgtggcaacaagaaatgagtaccaagtttgaagtacaggtcagtccatgattaattaaaaagaatagaatagtgtaggcacaggaaacagtatgaataaaggaaagagatgaaaataattctgacatctaactttcattgaatattgaccctgtgccaggcacagtactaagtgctttatgcgtaaactcattcaggataaaactagaaatgtagtgggaaaagctttaaacagtaaataagatggcccaggttttattcctggttctgccactatgttgtcacactaagatctttccttttctaggactcagttttatcatttggcaagtaactggtatgtcatgggaagtcctaaagcttcatcctactccaaattctatgtgaaaatatcaacacaggaaaaatgatctaatatcacaatgaaaatgggtgggaaatgattgttaggcattgaggctttagcacaaagatactagggctgggcgtggtggctcatgcctgtaatctcagcacttttagaggctgaggttggaggatcacttgagttcaggagtttgagaccagcctgggcaacacagtgagaccccatctctacaacaacaacaaaattttcttttaattagctgggtgtggttaatgcctctccagttgcatgcctgtagtcctagatactagggaggctgatgtgagaggatcacttgcgcctgggaggtcgaggctgcattgagccatgaacatgccactgcactccagctcgggtaacagagtgagatcctgtctcaaaaaataaataaataaagatactaggatcattcaattgttgaatgctatgttcaaggaattatgccaggtcacttcattttcatacatgtgaattttgtaaaatgtgaggtcctgacaaatacttacatgtgactttacataagagtgacccattcatatgcctataaaaaacaggcaggtaatgtgctatggttcggatgtggtttgctcagccctgccaagtgtcttgttgaaatttaattcccagtgctggaggaggggcctaatgggaggcatttgagacatggggatggattccttataaatgacttggtgctgtcttcatagtgatggtaaattctcactctattaatccccacaataactgattgttaaaaaggacctggcatctcctttccctctcttttgtttcttctctggccatgtgatctctacatgccagctcccctttgccttctgacatgggcggaagcttcctgaagcagacactggcaccatgcctcttgtaccgtgtgcagaaccatgagccaaataaacctcttttctttataaatcatctagcctcggatattcctttatagcaacataaatgtactaagacataatgtaaatgaataaacaaaattgcatagtgactggcaatctggagagcacatgttctatctaaacaagggggtcactatcatttcctcccaattgttagttatgtgggtatcatgctatatactcttctttgcaataattgagagaggattcagaaagatgaaaacaataattatgattaagctgttcatgtgttctatcttccattctaggtacttttcatacattatcatataactctatttttttttctctttggagacaagagttttgctctgtcacccaggctggagtgccgtgggacgatctcggctcactgcaacctccacctcccaggttcaagcaattatcatgcctcagcctcccgaacagttgggactacaagtgtgcaccaccacatactaccacacctggctaatttttgtatttgtagtagagatggggtttcaccatgttggccaggcttgtctcaaactcctgacctcaggtgatccaccgggctcagcctcctgaagtgctggcattacaggggtgagccaacttgcctggcctaatttggtgtgtgtgtttttaatagaaacggggtttcaccatgctggccaggctggtctcaagctcctgacctcaggtgatccacctgccttggcctcccaaagtcctgggattacaggcatgagccaacacgtccagccattatcatgtaactcttaatgctggggttatatcttttgttcccatttcaggtaagagggatttggagctcagggaagttaaacgtctctgaacatccaaattttttactaatattgagaaaggaagaaggtgatgtcaagtttcaaactcacaacaatcggctataaagccctcattttcccagtatccaatgcagcctagtgagacaagaaagtagtgaacagactaaagcgagtacagtaaatttgatcatatttctcttctggaattaaagtctcgaataaaatctgacagtctcaattcatgccacagaaaacaaaatggaaatattaaaaatatatcacattaaagtgagaggtggccatggaaatgaaaaaccacagttctggactccctcgggtgagacaacagacatccctgggtgctatgtcattcaacctatcatcaagatctacctggtctacctctagttgctttttctacttaggtgcaatcacttatctgtttttgcctcagtgttgatcaggatggttcatgcatttctatctgaaacatttggttggatcagacagaggcttggtttcaaggttaccattttcctagtatttagtactgacttttctgaattataattgcatattccttaactttgttttatttatctgccttcctgactcactgcccatgccagtccctggtcacagcaaaccctcacaccatgccaggacccctgctctatcttgtccataacttctgtatgacaacttctatataatagctaggtagtccaattccagggggcttcccaagtgtctgtagcttgtatcagtctttgacatgataaacatttttattttcaagacatactggggagcagtctccaaagggtatatgaagttaattcatcattaaaatactgaacttttttttttttttttttttgcatcatcagtatagttaagagctttacagcccacctgttaaacagcttcagcagatgcttctgggagctgattttccagactgtaacaactttataatttgagcaactttaatcaagattcttaccttggcagatgccagctttttgcttcaatttcataccaggctcttctgacactttgtttgttgaaaattttgctctttatttgatccccaatgatttcttgcttcctgagttcctctagattaatatctaacagctgtttatgtatcatgtgaaaatcttatataattaagactttaaccctctacaccgtttattttcaaacctagactgtgttaacttattctgtagtttgaagaaagtttcttccatgtcatttcttatgcatactctaaaataaagagctacttaatggacagtgatatcccacagcccgtaaatattaatatgagtgccattagttagagtggaatacactcatttgtgaatgtttttaaagaatataaatgctaatttatttttgcattacaggatatattcttagcatttggaatcattttggcttaattggtatcaactcttctcacataaataaatgaataaatgaaactcaaattgctagcccccagtgacacaagagaaactgacttctggcgcctttttaaaccttttcactgactactacactcgcaatcatccaattaatgagaagaacccttttggctgacacaatgtggctttgatggagaatcgtaaacacaatgcatgaagcttgtttgttccagaaaatatctcattagatataattaagatacacaaaaaggaggtacttaaattctatagctcattgccaatctaatatctcagccattcacaaataaatctcagtcattttaatgcaattgggattatattggaattagtagtttagagttgatatactgtctcccactgaaagcttccaaggtgaaagtcaaacaaaaataaataaaaaatattaaatataacatctttagaaaatactgtttggaaagagtaactagttaattatttggcaaaaaataatgtaatagtcattttttgaggtttggtggttaatgtaaaaacatatagagaaagcttacagcattaagaagcatgggttttggttcaggattcagtgtggctacagcacaagaaaattaatttagatcttgtgggctgcctctcaaacacaacagcagacattgtttttaaaaagatattacctaaatcattcatgcattaaaaactcaattaagaaaagtttgttgctaagaatgagttagcagttttgaggatatgatgaggttttgagatgtagttcttaacattgagtcttcagggatttaataagttcctttgcggagcccctctatgattcttcatttatttcagcactctgtctcttgctacaaattcatagagtacaaacttatgaatagtccacccacaacaactattgctatttgtcatgactcgtgaactgacacatgatcataagaaaccccataaaaacaaataaatgagtgtcttgactgtctgtatctgaaatatctacgcattatggagtatggactatgtgtcaaatgctgtactatgcactacttcttagattagcccaggtagctgatctcttattaggaccatttcttctttttcacaggtgtggaaacttggtctcagagagatgatatggcttgcctaagaagcagctaacaagtagagagacgttttgaagctaagcagtttgtctctagagcttaagctcctaatgctattccattggaactcttggtattagtataagtaaacagattcatttgagtcagatggctaaagtaaattaatggctgattgctctgctcaaagtagagaaataagctcaataaattccatctgtccttacatttttaaagatttcaccagaagaaaacagcttccaagcctaacctcaggtgagatgcaaaaccaaagtttttctcttttttaaaaatctttatctgttttagtcaaagaccccagatttttacagagtagttgttacagaatatttactgcccaccaattattccatacacctccctacacttccagccttctttgcctgtatgctggagccatggatctagctttgccaatcgatactgacagaaaatacatgttttatgtctgggctgggacagtgagttcctctttttccagtggtatccttagaatccacttcagatgacagagctgtaagatatagaagtgctgcctccatatgcactgaaattagagtttatgtaaaactctgattgtattaagtgactaagatttgggaatcattgttgctgcattgtagcctaaccgaatctgactgactaaagtttgtcagtgagttaaaaatgcagctatgtatccatctatgcatgtctttctggtcaccttggagacacccttccttggaaggcagaaagtgttttgtgtgctaaccattagcaggatgcccaataccggccctcatccagagtgaactaacagcatgaacagccctctgtgagcttagaacatagaaattggaaatgatgatgcgtgcctaattagaaactggactcattgtcactggtagccttcagcttgtggctgggcagaagtcactctgctcacccataatgaaaggggtgtgtaaattttccatggtggtcaccattgttcctgtgtgttgaggcaagtcagaaaaaactgcactgctctttggcagaatgccaggaaaaccacagacatttgttcagactcttcggcaaggatgagtttatatcaaaatcttgccataaccaaaaaggtcaaatgaaaggcaaggtaatgttgccatctttttttcttctttttgggaaaatatgtgtccttttaaatacatgatattctagatactactttccctgatctgaaataaagttaatatttaaacaaaattatgtactatctaatctcctgagatgtactacatcagaatcaaatgtgtagatatttaaggaagaaagtttaaagtagatctcctgggttttgtgttataatctgggaatttattagagtaatctgagaaagccaagcccccttcccttgtctttaaagacccaaaatcatatctcacagttaaaagaaatttttttaaaattaagtgtctcaattcagaagatttctaagcaactcacatgttctggccacaagtaaattttccctcatacaaatacacaaacttaaaggaaatattaaatgccaaataacaatagttatcagccaatctgcgatcctctattctgagaatttgtcattacgcctttcaagttatctccaaatcccacctgctttcagatcctcagaagctggctttctgttttgctatgattgctcaatagaaaataaacagatggggctgaaaaaaatccagaaatacaaatggggtagaaactgcctcgggcttttgaacagcatcagaggaagttgtattttttatttttcctgtttgacaaacaaatctcttggaacacaaacctcgatatggttttactctaaatcaccatcaaatatgtttgcttttgttttatttctcttgaaattcacagctaattttaggatttatccttttaattgagatgagtgaatgatcaataattggtatttgaatatattaaactgggggaaacatccttgtaagacatcagtatatatggattcctttatttcatcgtgaaaatttcaggggcactaatctcattaattgctttcaaataaaggccatatccattgacagctgacaaagataaattatgtccaggacaggtttcagttttcatgcatattcttgccctttatgtgtggatgtccacatacagggatctaagttaaacatataatttttttatgtccaatactctattttctatgtgcttttttgtttatagaactttgtcagataacttcaagtataagaccttgagggggaaatggaagggcagagatgctaaatgctacagccccaaagggatgcagggtgcagttgtacagtttgtatcctgaacaaggcgccagcccaagggtgtaaatagggacttaaatccaatctgagttcagttccccaatccaaactcaggttggtgagtgctatatcggtctgtactaggaagttttcaagttagtcccacccctgatgggattcaggtgggaaatgcagagaagtcgtctttttttctctttcacacagagacatcatatggtcctagcagtggccaggttactctgaaagaaagaagcgaaagctgcttttgtgattctttccacttccaagatgaaccatcatggtaccaatccagttaattcagaaacacacacagaaaaggctgaacaagtgaggttaaattaggtaattttgaaattccagattcactatgacagtctatcaaaagtgaaggaatgaagactgaaatgttgacaaaatgccacagctacagcaaacttttgcatggccctgaaaggcaataaaaagtagtagttaagaccatagaatttggattcagccagtccacagtgctctgttcaaactgctagctgtatgtatataaccgtttactacatactctttatgtccctctctctttctaggtaaaattagcaaaaaaaaaaaaaaaaaaaagaaaagaaaagaaaagaaaaaaaagcactgttctgtgacaattcataatgtgcatttaggtgccccatcatgggtgattattgtgccagcatcatgatgattatcatcattatagtcattattgcagtcctgagtcttaaatcccatatatgaactctaatttccttcagaggaaagtttcattgttagctccttgaaggtagggctgttcatgtctccagcttctgtcataaactttgaatacagtgtatattcaataaatattttctgaataactgaatgtttgaaataggcattaaaaaactcaagttatcctcctactgttatcatttgcatatgtaatacacactttaatcctgaattgtaagtagctcaagtgaagtaatacctggcttgcctacatcataatttcattgtgtacatcaagtaagactttatgtactaaagaaatttgcaggccatacaggtttatgcaaatataaagtatttccttctgtaaagatatagaaatataaacataaaaatataaagagtatatacaatatttaccttcctgcccataaaaaataatcaaaattaatcatttttaagcacttatatgtaaggcgttgtgcagcaatacagatacattacctcatttaacttccaaaacaaccctgagttaggcacagttttacccccattttacaaactgaagcttagaaagaccatacaactttctaaagaaaaacagctgctaagtcgtaaagcaaaaatttgaccaaagtttatctgactccaacttctctacccttaaccactactctattgtatacagactgaaaaaaagagaatattataatgttcaaagttaactagatagttttctctatatggttattcaaatgattttcaaaaacaatcttctaagatatattaaaaaaaaaacaaaaatgtctccatgaatgtgtttctgttttcacaagtttttcctggatatggatttacgagcaatttacctgggagaaatatgaaatgcactgagagacttcttagtggggaaaaatatgatattattttacagaaaagtccttccaaagtcctgtcttttcagggaaatggtatcctatcaattcttaggataggtgaactttatgaaagcagaggtaaattgtttgtaagtcttttgtcatccaatccattttaaataataagtatatcaatgtaattataattgtaattttagcatgaatcactaatagttgtttcatccataatcataaaagttacaaatcaaacaatgtcaatatgtcatcaacttattgaagtgcgggagactttgtaatggttcccaaagcatgagccataagtatgggcaacagaatcatctgagtgcatgttaaaaatgtatattttcaggtcttactcttgtttaatgtaatcagaattaatgaacttgggatacagaaacctccacctttgacacaccgcacacatgattttaatgcaatcttgagtttaagaactttttagagatagaacttctgcctcagaaactggtcatctagctcaaccccttgtttttatggatggagaaacaaacccatgttggtttagctactttccaaaggtcacacagctacttttcctattcacctttccatatatcttccagaatttttatgggttttatcatttgaaagatcctaaaaacttttttctacccagcatgagaagatgaatcagaaactaggttaagtgttccagggagatgaaaaattagtagattttcatgttaggatacaaccacagtgaagcttgccatgctcttactcacttctgagctctgccttaatgttctatcaaactaagctgtgagttaggctgtgggtagaacagtgccttcctcaaggacttgttactaaatgacatttaagtacaataagccatgattatagttgactatggaaataataagtaaaatcagtcagttgcctgcaactctgcttgtcttaatgattgatatcaggctttcccaaatctagacaataagatcacttttccattgattgactaacaggccaagagggataatgttgtgaacgtttgccaggccacatttcaattacctgtctggtatagaactgatattgaacagttgcaggtatggcccgaagatttaagattcattagacttataatcataccagaatgagaacaaaccaatcattattctaccaattgaaaaaataaagcttaaaaagtaaaatgagccttaaaacttacctgacaaattccttaactttatagagaaggaaacaaaggccctacaaagtcaaataatatataataatatatacagagtcacataaaaatacagtggcagatctggggcagtaatcataatatcaactttaattcaaacatgatgctaagtactttatattccattagcttattaaacttccattagcaatgaggaaaataaatttcaaagcggttaagattttagagtgattgcctaaaatcacatatctagtatatagagaagctgagatctaaaccattatatcagaatcatgatgcttagacccaggtctaacttttcctgtaccatcctgctctcacactttcaatttccactaaactggtttagtgcctcttcttcagtgaaactcttgatgttgaattggttttgtatcccaaattgggcttcaccaaggcttcaagaaacactttattgccaagctactagaagtcagcaaatgaaaaatataagatgagtttataagccagtcaaggaaattctgtgcttccaaatgtcactgctgtcatttagatgattagcagatttgcagagcaactggaagcttgggaccaacttgaagcattacttctcttggtaatggacggggcacatgagatcaggatgtgtcataaatggctacttatgtagcaaagttctcagataatgagataaatggaaatgacgggaaacacatgtacagagagagattgagagagaaagagaaggcactaaaaaaggaaaagaagcccagagtaggaaaccaaataaaccaataaagttgctgggcaaagcacatatatgcttgcaatgaagactacaagggaaactcatctacttccttgtacaaaaggacagctgcagtacatctgctgcttttgtagaagcagaagcagttaagagaagaataaaatacagagaagatctgctgcaagctgcctgttaaaaagcagccattctgtggctgacacacctgtaaaggaaaaataataccagccgtacatgttaaaggaaactgctggggcaccagcccagtgaacagagatgaggttcaaatctgattcttctactgattagaatgattgtgactattgttgtaactgtttttattaatttagttattactattatttcagacattttaaatgttaaaaatatttggggcctaagaacatagatttacatagatttcagaagtagcatctaacactatgtacaggccatggttaacaaacaacctgtgggcaaggcacagtgctgacctcagcactttgggaggctaatgtgagaatattgcttgagcccaagagtttgagaccagcctgagcaacatagtgggacctcgtctctataaaaaagtaaagaatcagcctggaatggcggtatactaccatagcctcagctacttgggaggttgaggcgggaagattgcttgagccagggaggtcaaggttgcagtgagatgagatcatgccactgcactacagcctgggtgacagagggagattatgtatcaaaagaaaaaaaaagtgcgtataaatacctgacattcatatcaacagtcatgtggcagccatgtgaagatggccagtgaatggagagttcccttcaaagatggatacaattgcaacaagtggacggaatgagatgcaaaaagggatggaggcagggagtgaaaggatacacataaaaagatgaaagcaatttgacagtagaatatgacgtatgaagggtttgtcaaagagataagatggtaggtggaggcaatgtcatagaaggctgtgggggcaaggccttactgtattctattcactaagcgatggacgagttattgacagttttgagacagttgtgtggtacgcatgaaacatcaaattaaccaccaactaccaatctaaggagacataaacctttatgagcacaaaattcacacagaaattggaaggaattttctctatcataagtggaaatagggccatatagcattcccataacaaaagttacagggagatttccaaagtcctctttccaaagtcctttttccaagttacagatttccaaagtttcaaaaatgaataactttcaccttcttgaaggatgaccatcaccatccacccttctctcctctctcttcctacctctctacatcagctactttttttttttttttttttgagatggagtctcgctctgttgcccaggctggaatgcaatggtgccatcttggctcactacaacctccagctcccaggtttaagtgattctcctgcctcggcctcccaagtaggtgggactacaggcatgcaccaccacatccggccaatttctgtatttttagtagtgacgaggtttcttcaggttggtcaggctggcctcacactcctgacctctagtgattcgtctgcctcggcctcccaacgtgttgggattacaggcataagccacctgctttttcagcaattaaggctactttactactgagtctctcaccttgaaacctttcttcctacacctcttcaatatccatggatacaaaatggcagagggcgtggaagacaggcagtggtggtgtacattgtgttctaggatgaggagctggtggtaggaaggaagcaagagaggcgcaaacagagagaagggaatcctgggaagttttccttttccttccactcatttaacaaaacaaaaactagcacatcttcaaattaacaaggaataaagtgacttctgaattgtcctataatcaggtaacatcagatgtatcttcctcaagacagcaccaaatatggctataaaagacagccatatttgataaacaatgactgaatacctgttatttaactagagattctacaaaaccattatggcttccatttgaaaggaaaattgagcagcagccatgtggggtgaaacaacaaggaatccaccgtcccatttctaagtaaaacagagtaagataaacaacattccactcaaagttaaacacattataaagaggaaaaaagggaattcaagattctctgccattaagaatgttaattttgtattcataatataaataaaaatatattctaaaagtatttcataaaggaagataaaatgtcaaaaagtagctttatgttctaaatagactttaacgattatggaataacaaaaacaaaagataataggagacgtgcagtcacaatttagaggtatactttgctgggtgagataagaaaaattataagaaaactaaatatggagtggcaaaactgttggcagtaatgagttgaactggctttgcagaaaatataatcattggaagaagactgtgagatgctattccagaacagataaaaaggataaagaactgaaaatgatgacagaaaaattgtagaaagccaggactaaaaattaggattcaactttcagataatgaatgtttctaacccatgcaaatggattcaaacataattcaaagatctaagcaaagaattcattccttagccttgtcgtggcgtttctgattaaaagccatcaacaaatagtagagtttaattcagttaggttggtattgactcagagagtaagattagggaaataaaaaatctgagaaatgccccccacccccaaaataaaaattgattatgagataaaagttatattatggctcagtgcggaaagatggattattgccacaactagctgtttataaaaagttcaagttatggacttataatgtctttgtttgggctgctataatgaaaataccatagattgggtagcttacaaacaacagaaattcatttctcacagctctggagtctgcaaagtcctagatcaaagcattagtagatttggtgtctgatgaaggcctgtttcctggttcatatacagctgcttcttagccataaccttttatggcagaagggatgaaggagctgtcaagggtttcttctataaggacactaatcccattcctgagagctccatcctcatgatctaatcacctcccacagacccccaccttcaaataccatcacatcgagtatcagaatttaacaattgaatttggaggagaaacaaacattcagtctacagcatatactaccacatacaaaaacatatagcagatggatttagaagttaattattaaaaatgaaatcatatatgcactaacaaaaatatgttaatactcctgttatatgttgagggcatatttaaacacaaaagcaacaaaagaaattaaaaacaaaaaagttattaggtttgactaaccaattatcaaacaatctctcttccttggaaatccaaattttttgaaagaattgcctatattttcaggctttacaaactctgtactctctcattaaggcgctaaaacccgacttccaccccaacaaattcaatataactgctcttgctaaggccaccaatatccaataatctactggtaatcaatgaaaaataccacaatattcttcttatttaatctcttgtaatagttaccataccctctctcttaaaattttaattggttttagtgaccttgaattcatcttattttctttccacttagggccccaactagcacatatagagctttcacaaaaattgggaaaatataataacagcatgctaaggcacaaagcatagtgcatgggattttaggcttcactcatgcctttagccaaatgcctgtgtacaatactcaacctgttcaactgcgtgtggtggccctcttcttctacctcttttagctcattctcatttccctttgcaaatttctaactacagtacttgattctacagtgatgtaagttaataatcataatattttaaatgcaagggtttcttccccaatttttagacttaagctatattcaaagcattgaagacataattatagaacagaatttaaaacacagaagccttggaaacatgaaaaagaagacagtaatataacgaacaaaagttaaaacgtgggtaaaaagggtaagtgcactaatttactcctgtttcatagtgggaggtcaatagatattgtgtgaaaagttattacatttagaaatgaaatcctatactataaggagctgtaatggtaaccaccagaatcagaaaaaaactaaaattaaaaagtgaaaacagccgttgcttctgagtagtaaaactggaggtgaaggggaggagtgaaattttaactttttattttgtgctctttcatactgtttaattttttaaccatttattatttcttcaataaaacaaacagtgcatatatccaatctaatatttattaagatgttaaaagaaaaaagaggttggatcagttaatctttaaggcttcttttatctgtagagtctggttttgtgatcagaaatacagcttagagagataagtcttgcagcagtgtgtagggtggattgcaatggagagagatggaagtgcagaagccaattactaggtttttatagtaaggaaggtgggaaagtaatgaggatctgagctgatgtgtaggcagcaggaatagaaagaaggttaaagatgtggagcctttgtggaggtagaatatatgtaatttggaaattgattggatggatgcacagggtttgagagaagatggtattaaattgactataacgtttcaagtcacggtaattataagactagtattagctgaaataagggagtcagatattagctgaagtgagagagtcaagagtagagggaatattgcaatggttaagccaagctgagtgaagcaaaattgtcattataagaagtgccttaatcattagcggatagggatttaggagaccatggtgatggtcaaaagaaatttgggcaggaatttgtcgaaaaggttggctactgtgctccagccagggatggttggaaatcatttctgaagttttatagtttgtagcttcatgtggtctgaattgaggacagaaaaaaaaaatctccattagtggagacaaaagcattgagtattgagacagctctgcattattctttaggattgacctgaccatgcatagcataaaaataaataataatagtatctaactagaaaagtctgttggacactgcagagtttatcaaagtaattactcctttagaatatctgttagtattaagaatataatatttaggcaaatagatgattattaaaaatatacagttacacctgtaacagttacctttatttacttttcttaacacactaaaattgcaataagaactgaatttcctaatttcatggaagtaaattaaactatctcctggggacatgaattcacagccatccactttacttggactttttttatatttacacctgcttctctctatggaacagattcaagacttttaaaatatataattaaaaattgtagttaattcaaaataaggaaatggggcgaggtaatgccagctgctattataaatgaaagcctgaaatctcaatggattaacaaaaatcaaaatttattcttctctcaagcaaaggtcatttagagcaggagtgggaacctactccatgcaattattcaaggaccaatgctgccagggcttttccatctcccgcatattctttacagattttcccagaacgtggagtcccctatcagcagctaggggacaagaaagatagaaatgcacaggaaatttttatgggccaagcctgaaaataataaacatcacttcagcttgcattcctttggcataaactcagtcatatggccacaactaactgcaacggatgctggaaaataagatctcactatatgcctcaagagaaaacaaaatggaattcatttggtaaatagctagccagtctctgccacggttcacctggctgatcatcaaatatctggtttactcttcatctcacacatagaattcatctatctccatcccaagccccacctagtgtcttgcaggtagctcagcttctgagatctgtgggtgaagtacacatggttccataagaaccccatatggctcctcatagatcagccacctgtgattgaaagggcaaagtaatctgctcccacctcagcacatgtgtgcacacacgcacacacacacacacacacagtagcaaaaggagaagcagtaacctcaaaaaaaatccctttagaaaagggaaaaacaggcaacggttacgtcactgatccatagaattatgaactccttgtggacacctctgacttggcagtggggtgagtttcttaattaaatttttattttgtcttcttggagccaggggagttgtcgttttctatatcctctgactctacctctagttggttttttcatgcttattgttttttgggcacatctgaagtgggtgacgagaagggggatttctcaggggtggctcacttccacaaggggctttctgcccaccttaagcctcaagaaatcaaatttatattttttaatctaggtgaatggagtttttacaaatgcaataccttaaaaatctgagtaggcatcttatttgtttgctttcagccaatttcatattctgatagccaaggtttttctgagacatagtttacaagtatgtgtgtgctttgttttttggctttgttttgtttgcttgttctttcacatgcctctctctcgcaaataaatggtggctatgatgtaggaggtgggacttgacttgagaggcagggctcagatactggaccaaattgagaactagttaaaacagggcccaggcggaagcagctttccataaagacacacccaccagtgtgtcacttcagcttatcatggccatggccacacccagaagttaccattcctttccatggcaatgacccaacaacccggaagttaccacccttttcctagaaatgtctgcatatactgccccttaatttgcatataattaaaagtgggtataaatgtgaatgcagaactgcctctgagcggctactctaggcacactgcctgggaggtagccctgctccacaaggagaagcacctctgctgctgctgtgcactgctgcttcaatacaagttgctgtttaacaccaccagctcatccttgaattctttcctgggtgaagccaagaagcctcccaagctaagccccaattcagaggcttgcctattttgcatcagctatcttgaagcttccaatttaactggaaagtcccatcccaactggactttgctacaaggttaaatcaaaacagaactttgttactcagaggcttttcctattttatttcctgtttgtcatccagaagcacaactttctcaaatcctgcaggacctcaaatttctaaacacattttacttccttttattctctgtgcacagcagttaattatttttcaaactgatctctgtcttctgatactatgttttgctcaaccagtgacaaccagtgctcaccaatattctttttcaatcctttttcttatagccaaaaactctttatatatgttatctgccttctaaattattactattattattattatttgagatggagtctcactctgtcacctaggctggagtgcagtggtgcaatctcggctcactgaaacttccacctcccaggttcaagcaactctcctgcctcagcctcccaagttcctgggactacaggcatgctccaccacgcccagctaattttttgtatttttagtagagatgaggtttcaccacattggccaggctggtctcgaactcctgacctcaggtgatctgccctcttcgacctcccaaagtgctgagactacaggcgtgagctaccatgcccagaccaggttattaacaggcaaacaaatattttgcctctgagaaacttgcatttcttttttttttttttctttttttgagagtctcgctcagtcgcccaggctggagtgcaatggcgtgatctcggctcactgcaacctccaacctcccgggttcaagtgattgtcctgcctcagcctcccgagtagctgggactacaggcgcctgccaccacgcccagctaatttttgtatttttagtagagatggggtttcatcatattggccagggtggtctcgaactcctgacctcatgatccgcccacctcggcctccagaagtgctgggattacaggcgtgagccaccgcgcccagccaagaaacctgaaatttctatacttttttttttgcctctgacatcagtctttttgtcacctacttatgaactacaaagcaaagggaaaccttggaagggacgttttaaggatggcagagcctctatcaacctggaatctcagatgtctgtgttaagcagaacccactgtgctataatttttgttatagcaacactcaaagtctgtttccagtctgctaatcaatagggtagttgttgctgtaaccgatacactccaaagccttggtggctttgtgcattaaaagtttatttcttgctcatgtaagttattactattggcagggagtgggatattggggttgaaaggggctctgctgtcttcgatacatacattccaaggtgaccctagcccttgtcaatcagaggggaattttggggaagggagagaagatcagcagtatgtagccaggcctgaatataacacacatcacttgtacctacatttcattgattagaatcagttatgtggacccaactaccttcaagggaggctggaaagtatggcctaattgtgttctcagtgggaaggggaaacaggaaaaagatagagcctcggccacagaagctaaatgattgctttgatagaccattcacgttgtgtctgagcttcccaactaccagggtaaaaatgaagcatgttaataagacaagacatacagttccttaggggagaagaaggctttcctggaaataaattccaaaaagaactttcttcctaatgtggaaacttgaataggaactgtgaaatggtataacagacagtgctttcaacaagacccttaaaatcaatttaatagtgcttttcatatatttcacatgacattaagtagtaatttgagaaaagtttttccttcattagtaagagccaagatccccattttaaagaggatgtacaatattttatggtggctctgtcagccttggagaatacccttgtcccttaattgttcttctctaatctcttctctaaagagaatgaaatgctctaatgcttttcacttgaaagcgagaagcaaatgaatctccttgagcctcatttggagagatttatcatggacaccatcctggaagcaactgtttccaactatgccattgacaagtctgttagcataaagaaacactgtttcctaaccctaactccaaccaccgtgtaagaagagagtgacacgagtgctcacagcctgcagctgaagaacaaagcaggcaaaggagcattctagcataaagagaaaaacattccaagtatattttgaaatcacagagccatgggctcgaaattcacccctgtcccacgacagttgtgtgacttttgacaacttacttcactgtttcaagcaccaggttttatcagtaataacccaatcctcatagactgtaagaaccaaaagagttcatgcacataaacaacactgcacaaggctcagtaaataaaaagtcacacaataaagataagctatcattgttgttattaatttattattatgtaaaacatgtgaaagcttagcagagtgcttggaacattttatgactaaacagatgttaaccgcctttgatgccattccttctttcacttggccatgtataaccacatgtatctgtttccataatgtatctttatacataaatagtatatctccaaatcataccaaatgtttttttaatgtataataaaaccaggctggagaaggtggctcatgcctgtaatctcagtgctttggaaggctgaggcaggaggattgcttgaggccaggagttctagaccagcctgggcagcatagcaagaccttcatctctacaaaaactaaaaataaaacaagacaggcatggtggctggtgcctgtagtaccagctacttgggaagctcaggtaggaggatcactagagcctaggtgctcaaggttacagtaagctgtgatcacaccaccgcctccagcctgggatgacaccaagatcctgtcacaaaaaaaagagagagagagagagagaaagaaaaggaaaacaaatagaagagtgggctctatctaaatattgatttgaaagaaggaactggggtgtcgtctaaattcttgcaaatagagcaaacattgtgattcttgagtatagttcatggaagatggagaaagactgtgctattatataaactaatcttatcaacagttacaataaaagcacttcccagaattatgcgatactcattttttttcagaattccatgctactttaggagatgacccatacgtccaataaaatcagcattcttgttctcagatacaattttatttacctgtggccatctgcaaaagtaacataatcatagtctatcatagtctattttttcttatcaaagtctatttgattgatctcactgttcttgcagttctttgaaaagccataaataagagtacaaatatgtcaaacaaacatttaccatatacaacatccaattattaaactatatgttgtgttctagtagtacataacatattttggttatggctatggatgacttatctattgttccactttacaatttttattacattagtatattattgtttatttattttgctatttaataatatgataatttttttacctactttctcatatgcacttcccagaaactcagtgaagaaaaagttgcaatcaagatggcaagaactgttggatttctaacttccgtataaaggtaccaaaaatagttcttctttcctacatccaaggtagacatttatttcttctactttgaacaatatacatgtgtttacctaaaatatccaaagtttattttccaaattttgttttcttattttaaataatttgttacaaaagtatctgagtaatttaagtcttaacatccacatttttttaattaaacaataagaacatttttcatgatatgaaagaagaacctaaatgaaataattcttttctcactatctgggaaggtcattagctaaggaagaattattttttaaatcataccttttataggcctattgtcattcactaatatgtggtaataaattatcaaaatattaataaatattatagttaagagaaagaccctgaaaccaaagagacttggtatgaaaatgaagtctccatactaaacagctgtatgactttcctaggtaatttacctaaaatctctgagctttagttctatcacttataaaacaggaaaatcacatgatctgtggcagatatgctgactgttcctctaatagccatgagctcttccataatttgtgcaccctgcaatttggcggggccgtgtgatacttatggacaatgggctcttctgggtcacccctgggtaaaaccatttaatagcagagagcaggtctccagatctttcttctctagacttaaggacatatggacatggtggcatcacaaaattgaggcagcctgaatctctgagtcacaacacactagagagtttctctgaaggttcacctgctcccatatcagagtgtgttgtgttaagtcactgagacttgggggtatatatacatatgtgtgtgtgttgatgctgcacagaaataaacaatcctgtgggttggtttgaggattaaataacagagtgatatgatgtagtgtcacaacttctaacacagtatgaattgaataggtgataccagatagtagcagtagtagtagtcgacattgtacaatcagccccagaatgaccctttgaaataatcacaagtagatattactatcaaactttgtaagagatgaaattagggctcgttccttctaagggccttacatataagcatgtgataggcctggagttcaaagccagtgcctgtttcctgagcactgtttttcccactaccactgtgacaatggtcagcgttttctacatcattgtgacgctgcactagaaattaacttccagcacgcattccaacaaataataacacatgcccatgttgaatatctcagcagaccaaaatatctgagcataaaaaatactcaacatgggaaacagcccttttatttcagagaggcatccaactattaataaactagttaatattcttgtatagtacatggtattgtctcagtcatatttgccatccagagacttattaaaaaatattttgtgtggagtttcaaaaattgtcctggggaatagacaatatgttttctgtcacccctgcccccactcacaattacctgatagctcagggaactacttctccagagtacttctccctaaatagcatgtctgggttagaacaattacaacggttaattgcgaatgaagggccttttaggcatctgaatgaattttgagaaataagtatttgctaggtggatggagttcaaatatgctgaaactgcagccggcattgttctaggccgttatttttagtgcactgaataacagctgctgcatatggtagttttcgagttttctgctaaagatccacttactggcacaaatagtaaatgtttgcatgtgctatttgatacatctcctgtgaggctccatttccacatttaaatatggatcacatatggtgaatcaaaataactttttgtatgtaaagcatatgtccaatgagtaaaccaaagagacatagtctatggcactgtcatgttccatatgtcttctatatgggttaaaatttaataaaaaataatacaatcagatgtgtgtaagaaaaagttcagtttcttagttataacgctagtaattggcaacaataaaaatatatacaatgtataataaatgctattgctcacattttaattaatagagactatgtaaagttataaaagtaataaacataaaatatataaaagtaataaaaataaaatattaaaatactgtaatgaatttctgtctattaaattcttagcaactatacaattcagaaacacaagagctctcttgaatctacttttttaaattttccatttttatgttagatttgggggatacatgtgcaggtctgttacatggtatattgtgtggtgctgaggtttggtcttccgttgatcccgtcacccagatagtgaacataatacccaataggaagtttctcagcccttacccctctcccactctctcttcttttgagtctcccgtgtctgctgttccaatctttatgtccatatgaacccaagatttagctcccacttgtaaaggagaatatgctttatgttctcctttataaaaccaaacagaacttggttttctgtttcggtgttagtttgcttaggataatggccactagttgcatccatgttgctgtagcagacatgatttcattctttttacggctatgtagtattccatagtatatatgtgccacattttttttcaatccatcctcagtgggtacctaggtagagcccatgtctttgctattgtgaatactactgcaataaacctgcaggtacatgtgtctttttggcaaaacaatttattttattttgcatatatactcactaacgggcttactgggtcaaatggtagttctattttaaattatttgagaaatctccaaactgctttccagagtaactgaactaatttgcattcccaccaacagtatataagcatttccttttctctgcagcctcaccagcatctgttgtttttggactttttaataacagccattctgactgatgtgaggtggtatctcgttgtgattttgatttgcatttctctggtgatttaggctatgttaaactaatttttttacatatgttttccttcttcagtaataaattaacctccagcctgggcaacatggcaagatcccatctctacaaaattaaaaaaactaaaaattagccaggtatggtggtggtgcctaaagtcccggctacctgggaggctgaggtgaaaggatctctggagaccgggaagtagaggctgcagtgggccgtgaccatgcctctgcactctatcatgggtgacaaagcaagactctgtctcaaaataattaaaattaaataaaaatcttagcttactttaactattttactatataaacttaattttttaaatttttacccttttgtaataacacttagcttaaaacaaacacatttgtacagctgtacaaaaatattttcattctttatatccttataccatgagcttttttctatttaaaatgctatttatttactttttaaactttatttaaaagtagaacataaacacacatattaacctagacctacagggagtcaggatcattaatatcactgtcttccacttccacatcttgtcctactggaaggtcttcggggacaataacaggcatggagctgtcaccccctaagacagcaatgccttcttctggaatttctcctgagggagctgcctgtggctgttttacaactaacttttttttatataactggaagaagtgcactctaaaataaccaataaaaaatacagtatagtaaatacataaaccagtagcatagttatttttgatgaagtattaggtactgcacataattgtacttgctatatgtctatacaactggcagtgcagtaagtttgtttccaccagcatcaccacgaacaggtgatgaatgggttgctctatgatattatggcatctatgatgttactatgcagtaggaatttttcagctccattataatcttaaggggtcaccatcatatacatatggtccatcattgatggaaacatccttatgcagtgttgtgactgtaacataaggaagggaaatgtgtgctatgagagagtactgtgggggtttatcaactaagaattgggaaactgagggcccagctgagttctgccaataactatgtgtgattctaggcttgtgaatgttttccctctatgggctaaaatgttctgcttcctgaagtaggtgggtgctatggactgaatgtgtcctcctcaaacatttatttgttgaagcactaacccttaatgtggcagtatttggaggtgggatctttgggaagcaattaggcttagatgaaggtaggacccccatgatgggaatcagtgattttataagaaagggaagagagaccagagcttattctctctctctctctctctctctctctctctctctctctctctctcattcctgctctctactcctctatctctctcctgtctctctctccctgtcatgggaagacacagcaggaagacagtcagttgtctgcaagccagaaagaaggccctcaccaggcaaccaaatcagtcatcagcgtctccatgttggacttcccagcctcctgaactgttagaaataaattcctatcgtttaaaccagtctacagtattctgttatagcagcccaagctgactaatacagtgggtaaattcaaaaaagctaaatggttttgtttatgtcctgtaactctcaggttgatatatctaacagtttcttccatgatgctaaaagtcataagaccttgcaaacgaatcaaaattaaattatgttctagtctgggttttatttttactgtatttcattttttaatttattttcaaatactttaaagctgaaaaccatgtaagacgtatgtgataactgagtaaaacagaatatttaattaaacagaacccctccttccccaagcattaggggatttacttgtaatttagttatataagtcctactggtattttacagcaaccctaagaagtaagaacattttaatactgttctctctagtattcaaaataatgaaacaatgacttgctaaggttatatcttcattgttcacaatattttaaataggttaatacatttataataaacactcttcaatgcagtacatatttgaaagaaatcttatttaaacagggcattacaaatgtaataaaaaggttgcatgataaaaatttgccctatccatgatacaggagacaaagatgaactttaaaatgaataccaaggataagctaaatactgtgggaatttgtcaccaaacttttacatttttattgtaacctactaaattatcttaattaaattttaataaagcccatcacaaaatgcaaattcctaagcatctgtttgacagctgactattattccattgtatggatgtaacacaattcattttcacagatcccttttcatggccatgtagatttcttccagtaatttgctattaaatgaaaagctaagttaacattcttatacacatatctttgcttattggtgtgaccatatatttatcctggataaattcttagatggtaacttactgggtcaaatcaacatgtagtaatgttgaaatgtatagacaacattggtgagaaaatatgtaacttgagttttagtaactaaattcattatagctcaggagttaccatttcaatagatcactgaaaataattacatttgtcagttcaaagtgtattggtcacctcttgtttaaaattcagtcacttttggggacgtattccataattatgggattcttcctccttccccactccccctgctttcacactgtgccatagatcatctacattcttagggatgaggcaagggaatactgcatatcctggcctcagctccatgtgctgcctttgatccttgttgcctctgttgagatgcctgttgatgcttagtcttaggttgtcagcctccgttcttcctacctcccacctgcatagttgaggccctctgcacatcttgtctgaactcgaggcctcttttttatccaatgtccttcttaccattgctatactgatggttgtgtagctcacagactcccagcggctttttcaacacctgactgagatttgttaaactgccttcaggtcaagaaatctcccacagccattgccattttactactacttaggtgtcatgatgcttcagtgtcatcctggatgcaggtctctagtttataagaggttggccatcttccatcatataagctcttatgcactgggatgccccccaaactattcatgaaagagttagactagtgttgcccttattaggcacccatgagcatctatgctcttatctcatcctctctggatcttccatttattctagtcaaaatcttactcatattgggtaggaagaaagtgatttcactatgcattttccctgtcctgtagccttacagtcaaatttttggctcactcttacaaccttcttgctgtagtgatagttgtaagccttatgatagtcgtaaactttacattttggaattctgagataaaccttttttctttctcttcaaagcccaatgctttcaagtcaaatgggctttaaaatttctaatgagtctaattaaatgttaatagattagatgcctgtcttgaaaagccatatatttacatcattcccgaaaaaaaaaacaaatggataatgatttggaaaatataagcatttatatatgattagctggttactttggaaaatgagtattgtaatgataaaaaaatccatttcatatttatttaagaactatattatgaattaagttatagatatcatagatgaatgatttcagagtctgtttttaaaaaatgggtcaacaatgaagaaaaccattgtcagaatgatgacatttttacacttagacttaggagataggtttttaccatcactggaagacaaaatagggaggcctttaaaatgatgtcattgaactgtgggaaataaagagttacacgtttctctggatttgagagatttcatataaaatgcactgtcaacttgtaaaaggatcacattgtctttccttgaagtttcttgtttataggaaatcgattatttctatttactaaaaagtcttcagagagtcctcattatcggagagtttatctgagcctaggctgtatatctactatggaggagttaagtgattatgacacagtattcactaatgaactaaacatttatttaaatattcccacttaaccattctttacagcttattactgtgtgtctatgactattatcaatgactttgtaggtcagcctactaacatgtagtaaacaatgccaaatcttgtacaagatgcaggatatcttgaagtcactgaagataattttagagaattaaccaattacagacaaatccattgatgatggcgagttaggccagttaaaaatgaaaagaaaattaatgcagatatagacaagatagacaactcaaataagaatgctttcaacctcaaagaattaaaaggagtccttgaggaaatttatcaaaatcttgagatgcccacaaatttctttttttcaaaaattagccgattgtgatctttctgggaaaattaaatgagaagtaaatagtatcatactgtgttatctatattgttgttgaaaaactaatatgagaaaaacagaaatcaacatttgataacgtgtgtgtccttcctaagcaataaacacataattgaaattagaacatacattttactaaatgaaagaaaatatttattttcataaattttagttttatttttcaagaaaaaaatctcaattacactttattttttacccctaaaaaccaataatgtattgacgtgcattttaaattggttttcttcaatgtcttttttccagtaccttttaaattttttttttggtttacttattttagagacagggtctcatgctgtcacccaggctgcagtgcagtggtatgatcatagattactatagcctggaactcctgggctcaagcaatcctcccgcctcagcctcctgtgtagctaggactataggtgtgcaccactatgcccagctaattattttattttttgtagagatggggtctcattatgtggcccaggctggtctggaactcctgacatcaagctatcttcccacctcagccttccaaagtgctgggattacaagtatgagccaccacactgggcagatggcacttttatgtggtgcaaatgtagctacacttagattactttttcagaattcctttccctgtgtgtctccaggatatcattggacacaaaagacattttacacaagatttggaaggtgaaagtgagacagaatttacatatatatattttatgttttggagatcgttgctgggctccatgtaccatggctgcttacaggtgttggcactgatgtgccagctcacctccttgggatggagcaacacccagatccacagctcttctagccagatgtcttccttcaacttctaatactgggccaaatgtgtcatagcttcatcatgaggaatatcaggttctcttgcaagtcacccaggcctttgaggttggagatggtagggagggcagatatgggttcaagtgtgtacttgagaattctaattgttctcatgggtcccagcttctctttgctctcatctacatgtggctttacttctccactgccagtgtggcagatctgtgatgtcttaagtctcaatagtggatgcagagggaacagcttgtatagagtgcccaaccaactttcatgattattccagatttgactacagtgtaccccatatcactcctagtgagttctgcttctctaatagaaccatgacttctccactagagtagtctcagatattgagaaccaaatagaatatgcaccgtgccatctcatggcagaagctggcttttttgttgcttgtttgtttgtttgttgatcctagtttctaatcagtggtatggaactaaaaatctattttttaattttaacattataaaaaattatcagcgacagtaaattcagacagggagttagaagatttatgttccaatcccagccctaacacttaacttgcagacttgagtaagaatgctctgaattttccaatgaaataaggattaaaaggaaaaaaaacgtgctttgtcctcttcatagagaattatgaatgtaaaattagacaaaactattaagatacacatacaaacttgcatgcacacacacacttacaccataatacccattcaaaatgtcttattttatgactaaatatgtcatcatgaagttatatactttgcacaatactagacatgggatatgaactacattagtcagacagcctcactgtgtaaatcattaaacacttatgaatgcatttaccccatgttaaaaaaaaaaaagcaaatagtactttgtgtctccatacttcatgatgaaactgtaagattaaacttgacggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccaccgccctccagcctgggcgacagagcgagactccgtctcaaaaaaaaaaaaaaaaaaaaaaaaaaaaacttgacacagtatgtgaaattgtaaactagtaggtattctactggaaatatattaagatagttttagtaccaccagcattattaagatgtgtgtgtatcttcccactgaggtacagagtccacacatggaggtactgactaagttttgtgcaactctcaactaggtgggagcaatttattttttatctaggcatgattcctgtttgtcctcattctcttggtcccttcagtcttttaggtcagttcactacttgccttttccttttctaaaataagtagtatagcagaggtcaatgctccaaaacattcaaactgttaccaattactttactttggagtgagtaaaacatctataccacaatgactagataaagaatgggcttaatctttccttgccatcccttacctcagtcaacacaagttgttgaaaaatgactgatgaaaaagcaaggctgagaatgaagctaggtccttcatagaaccaagatgtagtttgcagttgttgaattgcgcattgatcaggaatgtacagttacagtcatatatttcaggtataattcctattatcctgaaaggaagtagttaatctgtcattcctgttaactgaaactctctgccacagatgctaaataattgtgagcctgcttaagaaagagatggcaaaaactattttgtgaatataaattttttaaaacacacaatttttatttgcttcattaactgctactttaggggagagaaataggcacccactctgtgaactgatcatcttgataagaaagctaatgagacagaagccacatcaggtattgtcaacttcttttcctggtaatcaatacaagaacagcatcagcaatcattgattatgtgtttcctgtgtgccaaagattatgctaagagactcgtagggagtatataatttaatcccaacaaaccatatgcaataataggatcatataattttgcagataaggaaacagtgatgtagagagggttcctggcctgcccaaaattaccccatgttatcccagctatagggttgtccgacaaaacatcaaaaaaaaaaaaaaaaaaaacagctacattagaattcagacaaatgacaaataaattttaaatataatgtcccaaatatgtagtataagtatgcataaaagaaaatttgccctggaccatttaaacaggcaagaaatactattcatgactattgcaatggggagagagactatttcaatagggaaaagagactgaacagaattgggatgaaacaaaagaagagtttttaattgctgggtgagctagcagaaaggtactagagaatgctgggagcaggttgttcaatgtgactaggccatttgtgtttgctaattggtgcttattaaaattaggcctctgccccctcacagagactgggagatatagaccctaactttcctaataatcacatttcaaagggatagctctcaggtccttgagaacgacatttctgggatatagaagattcatatatcaaaggggtagaaaactaatgtgcaatttcaagctttctaaagtaaatgctcttaagaaaatgaaggtcaagggccaagagtcaggaagaaaactaaagtttagtcaagctagagaatgttgaggtcatcctggtcatgtgtcccaaatattatacaaaatataattatactaaaaaaaaatttgctaatctgaaattcaaatttaacagggcatcctgtatttctatctgctaaatctagcagccccatacaacgagcaagttgtggaaccagtacactgcattgatttgctcctgaattcctccctggcatataaaagcttttgattcagtgtttggtaaataaccaaagtttccagactctgtttccattttctattaattctctaactatccctatgtgtatgttcattttgtttagagagaatatgaggattattgccaagtgggagtgggaggcaggcctcaaggctgaatcagagcacaattattccttcaaggattatacagagaagaaatattttcactacttctctacagagcacttatagctctgctgtgttaccttgacacagaggaaagcatagcaagtattaaagcctctaaaccagcaattatgtgcccaaagaaaagatacttctgtagaccttcattttttaaattatattcttcatatatggctaaagcttttctttagttgtgagaaaacttgccccttcttgtttcaaaaaattaaaaatctaaaaaaaaaagaatccacacaaactaatacaaattccatattaaattgtagtcattatgtttatcaattacacacaaagtaattatcaaataatcatgttttagcggaatctaatctttttcattgtgttgaaggaggaatccatcacttttgttgttgtgcacttatcaacaataatttttaatatttttcaaatgcttatttagcatctgcacaggtgattaaattattttttccatagatttcttatcaaacagaatcatactaataagttcctaatattaagccattcttgcattcctgaaataacccatactagattataatgtggcatgatttgcaagaactgcttaatttgagttataaatattttattttagatttttaataaataataaaataatacataagattcttgtgtttagtacaatctttgtcaggtttttatatcaataatacactcagtcccttaagatagtttgtaaatgtacctttattttttacatgctgtaataaattaaagagcattacaattatttaaaaatttgattaaaccccctacgtaaccatctgagcctgaggtttttgagtgggatcttcttgatagcattcaatatttcttaaatgaaaatagattaatttgaattattttttaaaagtctgttttgataattatattttcctataaaattatacatttcattcaggtgtctaaatgtattcatacaaataataatattaattttcttttctctctttttaaattatttatttttagagatgtaatctagctatgttgcccaaatgccagggctcaagtgatcctctcaccacagcatcccacatttttctttttgtgattagtcaaccgtttattttactgttctactcccaaaatctatttgcatattgcttttactgtttttaagttttcacaataatttatttttgcatttatctttattataaattccttacttagaccttttattagtgtattttattttttctaattattttgcatctgacacttaatttatttgtccttattctttctttcttaaaaaaatgaatataagttttaaggttttgagtttcccttagagcattatgtcccttgggttctgatagatattatttttatttttctctgtaaatcttattctccagttttggtttttcctctttgaactaagagctgttcgaaagagagcatttaaatccctcagtggaagaatcttttgtgggggactgattttgtttgtatgcatagattttctgcaccatcatgggaatattatctgtattttttcactttcataaatttattgaaattacttctggcgtaatatttggttaatttttatgaatgttccatctgctcttaaaaagaagatatatttacatttgtaggaaattgaacattatttatacactattagttagatcagcctcttaaattattttttttgggtagttgctatagactgaatgtttgtgtcccacccaaaatttgtatgttgaaactaatcttcaagatgatggctgatggtatttggaggtggggcctgtgggaagtggttagctcttgggggaagggtggctaataaatgggaatagtacccttataaaagagaccacagagagctcccttcccctttccaccatgtgaggacacagtaaaagtacagctgtagagataacaggaagcgtccctcaccaaacgccagatctgcagcaccttgttcttggacttcccagcctcccaaacagtgaaacagtgagaaataaagctctgttgtttgtaagccaccaagtctatgatattctgttataacaaccctaactgactaagccagctgccaacacttacagtttgtcaacttcatttgtcacaatctgagtatattagccagctactattgtttccatttatctttatatttttataattttctctagtacaactttgagatcatgagctattggccatttgaggtttgtaaggtatatgtacagatgcatctacatattaatgttatgtgccatgttcatgatagggtacgttgtttctaaatttaactttattttctccaaattgcagtgtgtatattatgaggtaaagaaactgaataaaataaaatcatgtcattctcattactctactgattctctaatagacaacaaaccttatctgcccctatcatattagaaaaatcctgtgagtaccttttaaacatttctatgcaaccaggagcagattttcataagacctggtctttttaatagctttttcacaagaaaactggcttttacatcagtaatttaaatactaagttcacccacattttcatgttttcttggtgtgtgaaaagtgggcttaaactcctcacatgacttctacagagaaggaaacagagagaaaccagtctctcctgacctgaaaaacgaagtagccactggactgtgggcgtgaattgttctaaagaattcagtgccttgtcacactgttctgcctggtccatctttgaataaaaagtgcctaagcagagtttctttttcttattattatctgcttgctactcttcccccaaatcaaactaacgtgtattctagatctctaaattacttgctccttcttcagagccctcagccactcaatctgttacctcctttttcaagctgtattttttctttctttttttctaagtaaacctgacccacgaagtctttcttcatatcttcagattttagcattaataacaagtcttctccgaagaaatatcaaagagctttacattctattaattattctcctcatgttttcatctccttcctgtgtgatagttcctcatatttagacagtcatataataaatgttaaactccttgaagaaaaggaacatgcacttcagcaaaatgactagaacattcttttattccagtgaaactgaaaaaagaaaaaaaaaactatgtttctacagttacatgtatcagctattaatattctaatcacagattttgaaactagaaaagaaatatcattgagtcaaatccatgtatgttaaagttaacgaagctgatccacaaaggggggaaatgattctcttaatacctaaaacaactctatcattgttcagtagcctatttcttcaaacaatatttctactcatcatttatattatccctgcataaggataacttcctaggtttgtccttcagtcatttgagctacagatccagggaggaaagagttgtatgttttgtaaatctgaccactgagcttccctctaaatggggagtggcttgggtgacctgagaaaagggttacatttgtataaataatgtgcactaatggtgttcatgctgctaaaaaaatgctcctgctttcaaactatgctgcctggagagcacaggtggatttgtggattagctgtttaaatatttatgaagctatttagacatattttatttattgtaaaaatgtttatactataattatttcaagaattaagctttcacatgctatcagaggcttaaactaaaatctaattattctcaatcatatcctcctaatgctaggtcatgtccaagtggcaaagggtgagaaaagttctttaatggatatttgttgtcataaacttattgatcaatcaatcaatcaactcatattttcaaagcatctcctttgtgacaatctttggagagatgtgttgggtactctaacacagacttacaatgatagtaaatacatttactacttacaaagtatcaggagctggcatacattaactaatttaacacaaaagataatcattgaagtaggtcctattatcattccctctatatagatgaagaaacagtcattagattttaagaactcaatgttaattcgaaggcataggttattagtgtaagtacaaccaacaactcttgataaatgtcaaagtaggattgagaatcaattaaagacttatgagagttgcaaaaataaatcacacaactgagtgattaaaatacaaagaaatcagatatctgtaaagtcgtgacctatgtaccatacttggccatagtcaaatgtatattatgtagctcacattttgatgcatttaattatctcccaaaattgaataatcagcagacttcacataaaataccagatttctggctcctcgtataaaacaaaaaattagaagatctagaagctcttgcttcacattttcatatgatcacagtcagctggatctaagtaccgtttacatgtcttaggttagtatttactctccaatttaccataatcaccactgctctctaatgtctcttagaaggagcctaactcactcagatattctgctctcctggcttatgtagtcaaatgtgctaatgtacattgcttccttatcattactgggagcaagatgttatcggacatgtgaaatgaacataccattattttccctgtccagaagctaatggtcccatttagtagagaataaaaagaatagctcagagcaggctctcagtttcattcgtgtattcactaatagtgcatccatgagaattagatattattccccttaaatatacagggaccatatagtctttatcattcatacatgacacttatttctcagtgtgggtgtgggtgtgtgtgtgagagagagatacctgcacatggacatgtgattactagcctaaggccaacaaatactcttgattaggatgtataggtcaaacaaaatttttaaaagctcatattatatgacttcaaggttgttaacctaatcatttcatggtaattagaaaccctaattgacagcttagatttatttcttaaaaacctaaataaacccattgttttaggcattctttcaaaggcaatcttttctcagtgaaaatactgcgggactattctatttggtgcttagtgaaaatattttgaaataatgtatgtacaattattaaattcaaaattatttttgtcaaataaatagcagttaaaaaaaaaaaaaaagctcagatctctccctttctttccttttcctccaagtatattttagttaattttcttttttttaaagcactctgtttgatttgagggtgttttttctttttttttttcaaggtaggacaccactcaattttgaagcaaattagttgaaaatttaaaaatcagttaaaaatcatagttcctactattttcacttttcatacacaaaattttaataccactcttcagtaattttctttctctcttttattttactttcctttatcccttctagcctccaggagagaaacacaattttgggcaatgtttatcaagtaagaccaaacctcaaacccagtaagatgacacgcctgatgctcgaactgtgcatttaaataaaaaaccacaggcagacacaatcctttctccatacagaccactagacagaaaagtttggggattttaaatttcaagcttcctgacctcagaagttcccactgtgaatcacagtcacatatacctgttacagtacacttcttttcctcagtctatttaggaaactgtctttgtgcattggccctcaaaatttctcattttgtgtgcttctggtatggtggcttgtcaactcttcattgagttgaattagaaagcagaagagaatgcaggagcaggccctttatcaagaatttctgtagtcttacttacaaaatttcaggccttattttcccttcttaacttttttttcatggcatttatgttttgcaccacaaaagacagaaaacatgcttttaaaagaagcaattgcaagtgaaagtttttaggagggaaaagacacatgaggaaagggtgacgtggcttattttgaaagtgtgaatcacacactggaaccgtgatgccaccaaaaaaaccatggaaatacaccttcagaggtgaaaatatgattttcaggaatgtgataatagtttctacagagcacacagaaaatatcactgaaattttgttattccttttatttctcactaaaaagattagaaaattgaaaataagaccttatcataacaaataaatttgatatcaacctttaaagtttttgttaaaattaaatctcagaactgtcttagaaaaacatttgtactatcctgcccatttcttagttaagtaccattgttgagtgaccttggaatagcaatggttctcacacttggctggatattgaaatcacatagggacttaaaaagtgccgatgtctgggtcccaaccacagatattgccatgtcattgatctggggaacagcctggacatcaaaacttttttaagctcccaagtgattcagatttcaaccaagtttgtaaactactaaaaagaggaaattattttaactataaaaatagaaggagaacatataaagaagtaatattaaggagagaaatcagagtccctcttttctttctgaaacaagtcatcacacatatagaaaagagggaagaagtaattttgttctccatagaagagataaacaatagaaaacatttatactttgcactaaattctttattagatttaatgacatatcaaacaaaaatagcaatttcatattgttcaacctatgccacaattggctgacaaatatagatatattaaacaatggtaaaatgtttaacaatataaaggaaattactatgtatcaatcaggtttactcatgtgtaaaaaatatctttttcttaaaattttatattactttacagtttcccaaatactttaatacttaatgtcttatttgattatcccaatatctcaacatggaagagtgggaagatatcttcattttacagaaaacttaaggggcatgccaaaggtaacacttgcttgaggttaggcccagaaagacagtccaatgtctccgtggataaacgttgatttcttaaaccagccatttcttgttttgaaagctcttcactttttagataatatgaccccagaacttaggggcatttatgtgtctaataacaactctcttgaaagctttctgagaataagatgaagatgctgtggttgaatgtacagaaaagatgactatgtcctccatgaaaacaggatagtaccacttccatgatcttttgagtatagagagaggtaactttcttaaagaaaaaaaataactgcaattagagttataataggatcacctttgttctagactgtgtatatggtatattaatggcatttaatatctgatttaatcccttaaataagcgtatcgccctttaacaaggaaggaactaggattcagagatttgtgtaactttggtgtgcatactctttccataagtctagaggcataccaaaaaaaaaaaaaaaaaaaagaaaattaactctcttgaggatgagtagtcatgagttctattcttggttctgtcaccaacttcttatatgatcctcatcccacaaaaatattctccacttctcagaaggtcaagtcttaaggcctcatctaactctaaacttgcgtaagtataggggccatagttcaaaatgcaactctaaaatgcttagaatttagcttctgtttgtaaaatgcagcaggtatttactgtctgcaccgctcatatgttttaacttagtctaatccaaagacctctattttcctccagtgaaccaccttccttttcccagtcatagtgcaagaacttcaggcagaactgtttccacctctgatttcctgaactgacatgtgacttcagcctcattggttatatactcttcaccatggtaattcagggatgggaggtaacccaattccgatcaaagagatcagggttaagagttatttttccaaattagtctaaggaaagtttgttttctttcttgctgaacccggaggccgaatgacataggcctggagctgctgatggctcttggtggaacctgagaattaaaccagtttcattgcacagccaagggatggacgtaaaagatgacctgtcaatattgtttgaatccctaaatcaaaagttttctacaatttttcagtggtatgagtaataaatttcctttttcttttttttttaattattattttaatttaagttttagggtacatgtgcacattgtgcaggttagttacatatgtatacatgtgccatgctggtgtgctgcacccattaactcatcatttagcattaggtatatctcccaatgctatccctcccccctccccccaccccaccacagtccccagagtgtgatgttccccttcctgtgtccatgtgttctcattgttcaattcccacctatgagtgagaatatgcggtgtttggttttttgttcttgcgatagtttactgagaatgatgatttccaatttcatccacgtccctacaaaggacatgaactcatccttttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaataggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctgacaaagggctaatatccagaatctacaatgaactcaaacaaatttacaagaaaaaaacaaccccatcaaaaagtgggcgaaggacataaatttcctttttctgtttaagtcaacttggtttgattttctgtcacttggaactgaaaaatttctagccagtacttacaccccaagcacatcctttattggaaaacacagaaacatttgggtgatttaaaagatagaacattgggtgatagaaaagaaacaatgggtgattattatgggtttaggtcatggatgcctttgtgacaaaggacttaatttaatctgagctccggcaaagcagacgactcattagaaagctttcggatatacatgaaagaatgtctctttcaaataggattaaacaatagaggtagttaatgacacaagtaactgtaaggactaaaggttcatcaagatcaagcagaccaacgatattacaaagatccaatttatttctatatttctgtgtcatcttttgcaatggctgtttcatcttaatgctgtcgcaaaatggccaccagcagttacaagagttacaaaccactttgttctcttcctacaagtcaagagaacattatttctgacagctctcttaaaagtgtaagaaaacttctttcttagacgccctcattaaatgtctgctcataactaattggccctccttggttcctgtgccttgaaaccctacctgtggccctgggaactgaatgtgctaatctgcttaaattgggactgggtttagcttcaccagaagcacaaacgctaagtaaggggagagaaggagtgaacatcacagccacaatcaggatactatcgctaagaggatgagggagtcggatactgaactgtgaaaaattacaaatgttacagacagcatcaagtggccaaacaattacagcagattgtatctgaataaaaattattacatgggccctaagtctgtgggctgcatttttgtgccaaactgattactttccacagctctccaggttgtgaagtacatgtggaaggacttcaatgaagaaagttgtgttgaaaaaagaatgggatggggcctgttgaaccaggtggccttgcctgcatttcagaggtcgctctccaaagtcatatgtaaaatctggattaattaattttgatggatacaacttgaaggtgaatgaaactctctgtatatagtgaagccaagctgtttccaggaaggaatatttctgttaaacttagcatttttggtataaacataaacgtgtatagttcaatgtccacattaaccacaaaacatgggatttgcctccataaagcatgcaaaattgtttgaggctacattatggtttcacattttcagttctctccgtaatttatgtattcatttcacaagtatttagtagtctcactgcatgccagaagccatgttactcactaggttttaacagtgggcccatggtccaaactctgcattgagtgtcccacaaaaaatgtctacaaggtgaactaggaaggagtactagtaataaaaggatttgcaggcaagacagccgaagtctgataaatgtccacaccaaaattatcatctctacttacagataaagaaacaggacttcagacaagatgagtcatgaattctttattttcatactctctaagagttaacaagtcaccagttgtaccatggtgagagacgtttatgatgtatatgaattcctgggatataggattgatttttgtttggtatcctgctgtattttgttctagtttttaattcctataagttttagccatcatgtaagaattcagctggattcatacaaaaattattgataattagttacccttagtttcaggtttccatatatcttgctttataaggtacttctaaagtcataagagaaatttaatcaataaaattatcaaatatttagcatatttaaatctcagctgatccacaaggcatgaattagagccaacatgaacaccccttcttaagagatatttaattttcagttctgactcaaagatatttattcattctttattcaagagctagttgagtgtgtgtagcactgtaattgatgctattaatacaatgaattaattagaaatttggttgttgccgaaataaacagaacccatactagcttaaacaaaataaaaaaaaattaaaaatgcaacattttgactaatttaaccaaactgtagatggggcagaaatggaaccagtctttggataccacagcaccagggactctaatactttggacttctttctttctgcctgtctctctctttttctcttttatactttatcttatccctgattacgcatgttgatcttattcccttgggccagctgctctgatgaaggtggatccagggcattagacaattctggaattatatccacatgacctactaaccaagaggaaaacagtaccttcctcaccatgttcactttaaggacttcactgtgagacatatgccacgcccaacctcaaccacacaggtgttgggggctcatgagttaaacccggtcacaagacaaaaactttggccaaagttagtataattttcaaaagaaatgtagaagaaatcatcaaaacagatgtgatccctgccatcatcagagctttcggtataacgtgcaggacaaaatgtgaaacacataaattcatattaattacaatcgagatgagtgttaattagaagaaggatattttagaaaacataatatggatagtcagaaaaggattcttccaagaaagtgatgcctaagagagcatagtagttaactagatgaagggtgtgagacgttcccaggcagaggggaaaagaggaaaaatggaaagtataatgaaggcccaaaaatatgctttacagagtaaaaattagaaggttaaaacatcaaaagggatcttggataacctttaataagattttttttaacttctaagggtgtatgagagctaatattttattcacttcattaacatcttttcttaatccagttacacttacagaacaagcacagggctaggatcagaagacctgcttctgacactccatatactggatgacctcaagcaaatcaagcatttttccctgtcaagcattttcctctgggcactccattttctcatctttatatgaaggagattggattggactaagacatcattcctaatagtctgtgcctcatgcaaatgatgtaagctttgagaccagcaagatttgacattaatttggggtaaggacagaatgggattaagcattagccccatggagtgtcatatgatgaacggcactaaaactttaccagggtgataaaaaactacatgaaaatacaatgagatgaaaaaaatatatatttaatagagtcattgacaggaaaggttcatttaaaaggactacttggataagtcacccaggttggggataagaccaccaagtgacatgctcatggaagaggaacctctgagctatcttctaaggaaaatcaggctgggtaactgagtagttttgtttttctgattagggtctactaatttgtcatcaaagtgaattgtttaggaaaacaaagtagaggatgaaaaatgctaaccagccgtggtcctccatctccatctattttctatacaaatctcagactattccatcttctaaaactgaaaacatatttactgcctgggtgcagtggctcatgcctgtaaacctagcagtttgggaggctgaggcaggaggattgcttgagccccaaagtttgaaaccagccttggaaacatagtgagatcccacctctataacacgtaaaaaattagccaggcatggggcagtgtgcctatagtcccagctactcaggatgctgaggtgggagaatcccttgagcccaggagatcaatgcagcagtgagctgtgattttgccaccatactccagcctgggtgacagattgagaccctgcgaaagaaagaaaagagaaaagaaagaaagaaggaaggaaggaaggaaggaaggaaggaaggaaggaaggaaggaaggaaggaaggaaagaaaggaaaggaaaagaaaaaagaaaagaaaagaaggaaagaaagaagaaaagaaaacatatttactggatattggtttgaaaggttgccaaagtattaggctgtccagaatatgggttttggtacagtgctggtaaggaggagtgccttttgggttactgaataccacactactgcacttacctaaggtaacagatggaggtggccaagtctttcttttgtttgtttgttttagagatgagagtctcactctattgcccagtctggagtgcagtggtgcaatgatagatcattgtaacctagaagtcttgggatcaagccatcctcccactttagcctctctagtagctgggactacaggagtaggctaccatgcctggctaatttttttcccccagtagagacagggtcttgctatgttgctcaggctaagctcaaactcctagcctcaagtgatacttctgcctcagcctctcaaagtgttgggattagaggtatgagccactgcattaggcctgggcaaatctcgatgctcttcaagtggttgccagaggatgtttagcatcagatcccaagatatgagcacaactttgtgagttatctggtacagtataacatcattcaaggtttatcgcttatatacaatagccgtcttactgtagacagcccctaaccaagagaatgttgagaaagcctcaaattctgacagggctgacaagggaaggatgtgagtaggggcactagtgatcaaaagcactgactgtgaccttcagattgaaattaagcaacctgatgcagtaatatctaatcaggagagtgaaaggctgaaggtacaatcacatgtttccaggacactggtagacatggaagtaaattatcaatattaatctttgccaaaagaacagtagatttacagtgtatttgagttcttcagaggcagttgtaaatatcatttatcctattacatgctttctggaaaggaacacatacagactaatttggttgtttgttgcaatgaaaggagtcatcaggatgcatttttaatccaaatagatctcttgtgaaattattttccggagacatagtctaatgacacaaactaaaacagtatctatagctaattttggagtcagtagagaacactgagatttcaggcatctttacttagtgccactttcttttataaataatcagaggaaagcaaggtggtagtttggtgtcctttgtttgcctgttttgttgttaaccttgaaggaaagattgaaattaattttaaataatatctgcattcttatccatccacaaaagaactttattttgctttgttttcaaaaaattgcctctcaattattaaaatattctaatgttttagtcctttttttcccaaaagagggtattctgataaggaacattctagactactagcagaattaggttaatacttttaatgctttttttttttccttgattaagctgcttttactcattttaggcctcattttccctttttgatcatgaaggtatctccctaattcactgcaatcacatgaaaatttagcataataaaatttcaagtcacctatacatttactagttaaaaaggagaatttctcccattatctttaagatcagagacaacattttgcatctatcaattcctcatgcagtgctttgtattgtgtaaacaataagtaaatctttgatgaagataatcatgaagaagataatggtaataatcatgatgactatcaaataaaaataagttaatgtatgaataatcattttctaaactgtacatctctataaaaattaaagcaatgttgaagagaactaagttgtcatcaataatcatagattaccattatcagtgatgttaatattattcacacagatatgcaatgatctgactttctcatcacctcattttgcaagtatttcaggataaatgtgtgccactctgagttatttagaacaaaacataaatggagacttatcagcaatttagcaacctcagtaatattaaagttgttaaaacaatcaaatacagacttaaaagcaactaaatctgctatatttgcaagcccaaaatgctaccttaaaaaacttcgtatataatgttggttttatttccaaaggtcaaaagagggaaagattttgtacctgaatgttatgatgaacagcttagggaataaaataactaaaatacattatacacataagttgcagtcatttgaatatataatctgtgtattagcatcattaacatattcacattttcacaccatctgatgtttgccaaggaattataaattgatgtctccaaaaattacccaagcatgttgcatagagaagcaatgcaagaggtggagaggaaaccaaaaggtcaaaacaaagtgtttctctcaaatggagccagaatgccttaaagcattcagtttgcaactagataatctgagttaaatacttgaaaataatgcagatggaaggactgtgaatgttgctagaagcatgagatttccacctgtgattttctcacatttctgttattgatacttaaaaagtgaaagtgctatagaagtgctccccacacactctgttaacaaacatgacccttagcccttcaaaaaatgcctaatgctaaaacagagtaccatgaaaagacacatccctaaataaagagacagctagtcgtgaatggaggctagggtacctctcaagaatcctagcaattgcagaaatctgatccacttggacatttgtcttgtgaacaaccacatggcaaatcaatgaagctcatttatagtttggtaatggttgccaaaaaaaaaaagatttctaaaaacaaaaaattactgagtctgaggtctcagctaagaactgtaatgtgtgccaaatttacctattcttgtaagtccactttctatatggatagacactaaaagtgaagcctgctgaccgatggatagattaaccaaagattagaattgatattaaatagatcaaaaatatttctaaagaatttcctgctaactctccagagcatagtagggcctccgagcttattaatgttggtgctgtttaggctagaaagtagtactttttcttgtcagggttctcaagattgtgagagttttaaaaatatttttgttatgataatgggctctagtaaaaacaaccatcatcaacaaataaataagtcattgacttgattacagaaatcaacacagtcataatcatatgcaaacgtggtaggtatatattatccactgatgctcacaccaggcatggtggtgcatgcctgcgatcccagctacttgggaggctgaggcaggagaatcgcttgaacctgggaggtgaaggttgcggtgacccaagatcacaccatttcactccagcctgggcaacaagagcgaaactccatctcaaaaaagaaaaaaaaaaaataggaactactaaacaaaaattattaaatgtttcaaatgtttacatttaacaaattaatgtctgacgaatgtcttttttcaattctgccagtatttctgggactacatatactcccttatttgaagatgagatcaaaaatttaaatttgagccactgccctattgtgattgccaggcttcccctgtaacatgggatttgattttcaaatatgagtgtgtgtgcggggggaagaataataggcaattactttatacaaatatcattatattggaaggaatggtagacaaatagaaaatactgtttgaaactcaaaaaacgtcaaggatggagaggaggaataaatatttaacatatcaaaagcataatatttgagccaggcgtggtggctcacgcctgtaataccagcactttgggaggttgaggcgggcggttcatgaggtcaggagattgagaccatcctggccaacatggtgaaaccccccatctctactaaaaaaacaaaatttagttgggcatggtggtgcacacctgtattcccagctactcgggaggctgaggcaggagaatcacttgaacccgtgaggtggaggttgcagggagccaagattgcgccaccgcactccagcctggccacagagcgagacttcatcaaaaaaaaaaaaagcataatatttgaacatgacttctcacttataattattctctaaaagagtatcttatattctagtcattggaatacattttctgttactagaaggcaaggacagtgtgttaagcacataaaacaaacaagtactggactttaaaaagtgagcaaaacagcatcaccccataacattgtcctagtgttgcctggtatgttgtcaatgctcaaaaaatatttttatataaatgaatgaatacttgtcttgttgcaatgttaggtagcaggtcgattttggttgtagtattttgcagcccatgacttattttccttttcttaatcaagttggagaatctccaatacaaagtgcatctctggtgctttatttcttaatatacctacattctgcttagcaggcaatatttggtttggctggccttaagtaagaggaatctttcattagtagtttgagagtgtggcttccatgaaatatgtaatcaatcttgcatccagtgcatgaactcttgctaaaggcatgtattgcatgaaccctctacttgaatccaatgctctgcgaacactattcaactttcaagacacagtgagccaagaccacatctttgcagtatctcactggcttcagtgatggcccagctattattcagggacggatccaatagtccctgaagatttatttcctttattcttgacatgtttaaatgactagctgcagatgcatacaatctgaggtaatttagtcaagaaggaagtgcgtttactctagcgctcctctgccgaaacggtctagaggaagagtagattcgagaagcagccctgacataaagcatcgatacatccatctactcttttgacagatttgaataactgagaccaaactcttttattgcttgactgaattagactttttactttctctttctcctatgcaaattagatactaacaactctggtccttcataccttagaaccaagccaatcaaatgcctatttctttgagcttttgtgtttgaatatattcaatagtaataaaataagcagaaaaattaaagccagttctatcatattttctccacaaaaggcccttatactttgaggaaaatgtaatcaattaaacagtgacctctgtcacagtagggtcttcaacatataaatgaaactatataccttcatttagttaatggtccatagtaagtacatggagatacaaatattgcaaaattctgtacatactgagaagtagtctttaagcaattcttgtaagactggtttcagtgggcttagagacttctcttacaacagcactaaagaaattagttacataggctgcaggaaaatatgcttgtttagcacaaaacagtaagaaaggaggtggcaatgattcaccttgactacagggaatgattttataaagaatagaaatgataagtaaagaagttttatttgaaagcatttaagaagcaattataggcaatgaggggtaaaaaaaaagatgaagtagtaagtacttgaaagcttatgaataacaaataaggcttattcaggtaataacaggttacagcaaagttgctggaatatagtattccatcaatattaaggagaaggataaatacattcatgcttagctatttgaagaataaatccacatatgtatttttgtcactcctccaaaagaataaaagggtgcacctggtacacaagtcaaggttctatggtcccaatcagggtcaaatttttaacaataagtcaaccactaaggtacataaaagagccatgcacagcaataacattagttaaaaatgcaaaattctcctgagctgatacaactttccaacaaaaatattatccttaaattgttttcagagcttaaattaccaagactaagcgcaaatgcttctagctaaggctgtttcatgatacattgggttgtaaatttctcaaaaagaatgtttctattttaataagcttgttttcttcttctttctcttttcttatttcttttgcaatagtgtactttttctcattgacctttaattaattacctttaaagctagctaataaaatgtattgctcttgacatagatatctagaattaccttaatttaacacgttttagggcattcaactaaaaatgcaaagagattgtatttttttcagaactcagggccatagcataaaatcagatgccatgtgttgttatttccctagtgcgttaattataagaatatcttttacctgaggagtttagattgtatctgtatgcactttggttcgtcacataggtgataagtaagctgaaaccacagaatggtctgacatagaggtggagtccagagtttcagtcatcttctctaacctcagcctagttatttttaatgtctaagctaatgttattgaaggacaagttgcatgttattcaataattattttcacctctgtactaaactgtttcctaacttagataaccattacatattgccattaataatcctaaccaattataagataagatggaaacctggttccatcttactcactatgtaacaaccacatgtaattcctgatatagactgagtgcgtaacataaatgatacggggttaaagacttaggagttcactaactccttcggttgtctaaccttaccctcttgaatctctgcaaaagtgaacacatcagaggagctgccaagcagttgtgatttttgaccccttcctgtaaagattttatgaagcattaaaataaacccacattacacagtaaatacaatgttaaaaataattctataactttgtttttaaaattgtgtggctgtgagaaactcatttaacttattgcccatgatttctcagcaaacatgaggcatattcaaggattctgcaaagcgagaaaagtctaaccctcacagcgttcccataagtgatgaactattttggaaagtgaagttgacagaatatgtttttaacatattcaatcaaatatttattaatgtatattttgaggcttctttttcattttttggagaccacatctcaagtcctctgaaggtgctgaaaaacttacaagccctaaaaactggagggtccaaagtatgaaacagttccattttcacacctactttaactagagcagatcgaatttgaaccatcttacacattggacatctgctaaaaaaatatataatttttggagttggcaaaccactgatacagaactttttagcctaccaaatgtgaaaacataacaacatacacccctctttttaggaaaatgattattttgggggaaaatcataaagctatcacctggacatttcatttattcaaatataacgcagtcaatggcctgtgcttctatatgtgtaaattatctttgggatttgaaggttagttagctaaattacttgggctatttttttaaaaatccaattcagacttgttctgctatactatattcttcctcttgagatttcagctccctgagtctcctgacatctaagatctgagaaactaaaagttatctaagattagtatgtgggacattttaatctctattagaagatgaattctaacatattttatagataataaatgctttcaatatatcttcaataattgcagggagtaataaaacctgtctagtgtaggatatcatagtggttgataaaatgatcctattgataatcatataagatccaaatgatttcccaatgaactcccctttctttctaatcatgacttaagatctttgctgaatgcccatttcagattctgtgtaaacacatgaaatatggcttggagcttcttaatacttaattgtattaaagtactaggcctgtgctttaaatgtttctagaagaaaattgagtccttaaagagtaagacaagactacaatttttcatacagaatgcccagcactgaaaattacattaaggaagaaaaccaaatcaccaaatgccaagggaggtattctacttccaatagggaaacagtatcttgtatcagctcaattctccttcagataacaattataaatctgtaaaagaagggaatcacaataggtggaccctatatttacctaaattctctctctgaggtaacatcctggttcactatgacacagggaaatacgtataaagaggtagggctgcggagacagagactggagttcaggaccaccagaatggtttaacattgaaaagccctctaaaataagtcaacttcagatgggaacattttaaacatgaatgcagatttacctcatatacttggctgagtcttaaactgcaaatatacaaggtaagaattttaaatcataaagcaacatctgggtagcgaaatagctaagcagagcttccaacagttgcccaatgctagggagagttgaggtaaaatcctatcaacttagaggtacttgataaatacattgacttttccactgaaatgccccaaagtctagtaattaagagtaaggaacacatagaaggacaaccaacatcaccttggaactaagggcaaactgaagtaaacccatcttagcaagtctaaaactgagcgtcaatatgactgaagtgaactgccaataaattacttccttccagaagaaaactcaacattctttaaaggaaaataacaaaatcggaaatgtctaaaatataccaccaatactgtacagcacagaatataattttctaggtgtgcaagaaagcacagaactatcacccataacctagagctaaaggaatcaacagagacatgtacacagataatctattaggctggtgcaaaagttattgcagtttctgccattacttctaatatgtaattctactatatgttagaattagtagacaagaacttcaaaacaacgactaaaaacagtttaaatcatacacaataatggatgaacagaatgaggaaagagatggagaacttcaagacaaaatgggaagtttaaaaatggatataatagaaactctacaactaaaaagggcaataataaaaatgaaaattcgtgggatgtgcttaacagaacaccggacacagaaaaagaaaagatcaatgaactcaaagagaggccaatataaactatttaaattgatttcagagaaaaaaactaatttaaaaaatagcttttcaacaaatggtgctgcaaaaactgacattcacaggtcaaaaaggaatgcaaacactgactttacacctttcacaaaaattaactcaaaatgtattatagaactaaatgtaaaatgcaaaacagtaaaactcctagataggataggagaaaaactaggtgatcctgagtttgccaatgactgtttagataaaacatcagaagtgcaattcatgaagaaaaacttaaagttggacttcatcaaagataaaaacttttgctctgcaaaagatactgttaagagaatgaaaaggtaagcaaaagacaaagaaaatattaacaaaacacatatctgataaaggacttttattaaaaatatacaaagaagtcttaaaactccagaaaagcaaacacacaacacagtccaaaaatgattaaaagatctgaacagacacctcaccgaagataaactgatgacaaatgaacatattaaacctgctcccgagccaggcatggtgctgtgtgcctatagttccagctacttgagaggctgaggtgggagaattgtttgagcccatgaatttgagaccagtctgggcaacatagcgagatttcatcttgctttaaaaaaaaaaaaaaaaaaaaaaaaaaaaaaaagatgctaaatattgtatgcctttaggaaatagcaaactattaggttggtgcaatccctttcatgccaacctgataaaacatccacgagatactaccacacacctatttgaatggctaaagttcagaacactgacagcaccaaatactagtgagaatgtggagcaataggaactctaattcactgctggtaggaatgcaaaacggcacagccaaattggaagacactttggcagttttttacaaaactaaacatactgttagcataagatacagcaatcatgccccttggtatttacccaaatgagccaaaattttatgcccatcaaaaaccacaaatgattatagcagctttgttcattactgccaaaatttggaagcaaccaagatgtgctttagtagttgaatgaataaacaaactggtatatccagcctatgtgatactatttggtgattaaaaagaaatgacctatcaagctatgaaaagacaaggaataatcttaaatgcatatcgctaattgaaagaagccaatctgaaaggctacatcctatatggttctgactatatgacattctggaaaaagaccaaactatggagacagtaaaagtatcagtggcttccagggaaggataaataggtgctccaggaaagacggagcaaaaggtatttttagggcagtaaaactgtagtgtatgatgctgtaatagtgtatgtataccatatacatttctcaaaatccacagaatgtacactacaagtgaaccctaatgtaaaccatggattttggttcgttataatgtatcaatattggctcatcagttgagataaaggtaccatactaagataagacttaatcacagcagaaattatgcgtgtgtgctgggggtgggggtggtagcatgagaactctctgtatttgttttttgtttttgtttttttttgtttgtttttgtttttgttttgagatggagtctctctctgtcccctaagctggagtgcagttgtgcaatctccactcactgcaacctccacctcctgggttcaagttattcctctacctcagcctccaaagtggctaggacaacagtcacatgtccccatgcccagataatttttgtatttttagtagagacggatttacatcatgttggccaggctggtctcaaactcctgacctcaggtgatctgcctgcctcaacctcccaaagttttgggattacaggtgtgagccactgcacctggctatggattttctactcaatttttctgtaaacctaaggctgctctaaaaaataaagtctattaattttaaaaagtagaacagactatctaaactatgggcctatatcacataatctaatatacatgtaaaaggagtcctaggaaagagaatggggcaatggaaatatttgaagagatgatagctgaaagttttccaaatttgaagaaaatcatcaaccccaaacccaagaagttcagaaaacaacaagcagaataattgcaaataatatgttctatgaactattaggtgcatgatagtcaaattgctaaaatccaaggataaaaaaacaaatcttcaaaagcagccagcaggaaaacaaagcaaagaaggaatactactttcagaggaccaggatgagttataactgacttactagaaacagcaaaaatagaagacaaggaattattcttaatcatgtgaaaaagtcatcctagaagccatcctagaattctaaatcttcagcaataatagcatataaaaaaattctggaaaaataaaatttggtgggctttgtccccaagagactcacactaaaaggtgtttagttcaggctgaagtaataacaacttcctgatgtcttcaggaagatacattgctaaatgttacactttaaaaataatatttagaagactattgcctgttttattaaatattttaaatattgttttaaaacatgcaaagaaatgaaatatatgacaaaagagcatcactaaaaagccagtagaataaagaataaaattctctctaaaaatattcaatccaaaataaggcagaaaaaaaggaacaaagaaagatgagtccaatagaaaacaaaggacaagatggtgtatttaagtttaacaaatgtataaccacatacaatccaaatggactacactctaattgaaagacagatgcaatcccagcactttgggaggctgaagcaggatgatcacttgagcccaggagtttgagaccagcttgggcaacatagccagaccccatctctgcaaaaaattttaaaatgagccaacctgggcatggtggcacatgtctatagtcccacctatttgagaggctgaggtgggaggataagttgaactgggaggtcaaggctacagccatgattacaccactgcactccagcctgggtgacagtgagaatttgtctcaaaacggaaaaaacaaatgaaagaaagaaaaacagagaatgttttagacgcttaatctactggaggaagagtatgaaatcctccagttcccaagacccaagcaaagattcactacttcaggggaaagtgatagtagcaaaatccacctccccagggaaaggggcaagaaaccttctcacacagagaatcttgtctgactacaacagggctactaagcaggaacactgagaaagccctaatctgagccctgggctcacaggatctgcccaataagtgactacttgaggatgatgattgtattagtccattttcacactgctataaagaaatatcatagactgggtaatttgtaaaggaaagaggtttaattgactcacagttccacttggctggggaggcctcgggagagatagaaccatggtggaaggtgaagggaagcaagcaccttcttcacaaggcggcaggagagagaataaaagcgggcacaggaaaaagtgacacttttagaaccaccagatctcatgagactcactcactatcatgagaacagcagtggggaaactgccccataatccaatcacttccatccctcaacaagtggggattacagcccttgacacgtgtgggattccaatttgagatgagatttcggtggggacacagagccaaatgatattttatttcctttcatccatgggcaaaggtttgtaagatattttcaagaaaatttagagtgctaatatagtttcagtttcacaaatcttgaaactgctagtttttcccccaaatttgaaacttttttttggtttatgcaagacattttgaacaagttttaataaggcatttaaacatctcttcccttttctaaaatacatgcctctttaataattggaaggaaaccattacttttttaacacaatgtcgagttcagagctagataatgaagttaaacaagtatattcttcctttaagttttctaggtagatggtgtctttaaatctaaattaaaatatcttcgcatactttgagggcataagctttaggagtttcttataattgcttacattgacttttcctaggctgtaaattcagtcttgccttacaattaaaatgatttcaattacatttgtggtttacatttaaaaacctatgaagtacatttttttcctttataaaaagtatgcactggttttctttaaaagcatttcaaaatcttgaccataaaagcaaatagctgatttctttttaacaaaaacatgaacaagttacatattttacatgcgaggtaacattggggtatttataacatcattaccaaattctagttggtctaaataagtttcctaaaataatctctagtttggaacatactgaaaagagggaagcagcacagtataataaagtgcttgactgaaagtcacctgatctggcttctttttctgagtctatcactaactagctgggtgaccctctatgtctcagcttttcctctgtgcagttaagagtttggattatgttatctctctggtttctttcatatccgacattctttatgcacgctattcaattgccttattctatatttaacccctttttgctgtctctagtgaaagcatccagttttataagaagaagattaaatttgcattagaattacccagagatatttattaaacaacagattcctgggccgcagtcctatagctacaatttagtaagtatgaagtagggcccagttacatgaatttttaaccatcatggcaggtgattctgatttggtgcttacaggtacaagagcctacaatataaaatgctttgtattttaagggtaagggtaggatgagtagggtaggacaggtagggtatccatcccaccccgtcccctttccactgaaagccattttcatagctcaatacaatccttctctgccctcctcacccttcaatgtcccgcatatcctcattcttttgggacgtggtacaacagcttgagaaccgctgaacacaggtacaagctataacacaggcaagctggggaatgctatggtggccgaggcccaggtggggtgtcgctgctggccaagggtccccagcttgcaaagtgactgagaagaaatatcctacatcatttacaagcatcagagagtaacaaggcaataaagagctctatttctctaaggccatttctgattctggaagaggtgctgaaagacagggaaaattatcagtatttttaacagcttcatggagtaaggggagtctaggacttttaaaatataaaatgctttatattttaaagtaagttctattatccagcctagagaaatctaaagcctatattatatcaatagacatggagagaatttgattgacttgggatatatctatgaaatctactaaaccagactttcaatttcatcaatatgttgaacaaggatagaggaatttagggtgaagatcatgttctttgcttgggaagatggatggacagtaaagccttttactctgacagcaactaaggagtatgaccaaaaggggaatgagttaagagaatagtccagaaaattggcacattttagacattcttgcctatgacacattcacacagatttgttctgaaggcaaatggacatataagtccagttctcaggaaaaaggtttagaatgaggatagaaatttaacatttatccacatccagatggtaattaaggtccccaaaaaggataaaatgtccaagaaaaaataagctgtgagagaagttattttaggggatataaataacccaaatatatttaaggtagtcgatatccatatttaatgtgcatgaaaatcatctgggtgtttctgcagtttccaagggccttatcaaaagaaattcatagtttcttaaattgggctggatcccggagtctaatttttaacaagcactgcatgtgattctgatataagggatccttaaccacaatcggagggacactgaagtataggcttaatagcagacatttctcgttacaaagatagatgaataaatagatatgtttggacataaatatatgtttgttgaatagaatttgcatttgatccaaaataattactcttgcatgtcacaggctaaataaaaataataaccatctatatttatgaactatagtagctttatcctaagcactagattgagaattgagaaagagaaagcatcttacatgctttgtctctacattattgctccctagtactttactgagtgcttggtacataaatgcttaatatatattaattgagctgaattgtatgaataaaattattggtagattttgcttttcttttcttttaaaataaatacctataatagcaaaaaaaaagagcattatcgaattagaaagcctaatactgtaaacatatcaatttccctcagtctctcattcattacatgtgtgaacacggttaagtttcctaatcagtaaaacaggataataacagaaactgctgagacatccatgcagttaagggcagagtaggtaattaacaccacccatctccttgacgacaaactgaataaaatctttttaaaaatatgcttgtgatagaggcaggaggcagagaaattctaggcagacaggggtgggtccttggtgaaaccccacctgcaagacgaagacagtttaaagcctgaaagccaagctacaagttacatccttggacccgactgagaacttgtctttctgtttggcatgctttcccctgactggtctccacccttcacctattttacatatacctaccctttgctaattggtttttctacactgtcttgcccagctttgaatggtgtcttccctttaaccttttttgcatactcacaaaccaatcagcacacactccccattctgagtccataaaaggccccagaactagtcacatggggaactctctcaccttctggtaggggatcaatctccttgtgtctcctctccactgaaagccattttcattgctcaagtaaatgcttctctgccctcctcactcttcaatgtcccgcatattctcattcttttgggggatggtacaagaactcgggaaccactaaacacagttataaactataacacaggtgagctgagacacatcagtgtggccgagtgaggtccgggcagggtatcactgccagctggggattcttggcttgcaaagtgaccgaaaagaaaaaccctacatcatttgcaggcattggagagctaacaagacaatgaacagctttaagtaggaaagtcaggaaggttagaatggacttggaggctgttgtttctcaaggccatttctgattctggtagaggtgctgaaagacagggaaaattatcagtgcttttaacagtttcatggagtaaggggagtctaggacttctaaaaagagtaggttggtaaacccaccattctgtaggttaggatcatgtcaggctactctttaggaagagtatgacctgtaatccttacaacaggattaaggtaaactgagattgctatttcacctggccacctgtcagaatcaactataaatgctgtctggaaaaatgccatatcatcctaggtctcaaatcatttctacaacttttcagacaaaatgtctcacactgaatcaaaaataaccagtcacatgaggaagaaagaccacatggagcgttagagaacagacaatagaaataagaactgattcataagggttctgaataaaggagctattaaaaccagactttaaaataattaagattattacactcaaaaaagattaggatctttgttttagtatcaaatagaattgaaagcacaaaaattggagttacacactctttgtatattaagaaagcagaattaggcatagctggagagaaaaatagtaaactaatatgtgaatcagaagaaattatccagattgaatattaaggagcaaaagaaaaaggaaagagaaaaatatgaaggagatagccataaacctaggaaataaattaagaagttctaacagataagtcattggagttcaaaaggaaactatagaatcaggcaggagcagtatctgaaaatataatgcatagaagttttacaaaatgtaaaagagatgataagtcatatatttaagaagttctaccaatgatatgatacattgcaaaataaaatggccagaaatttctctcattcctgaatgaaaatcattttgcaatgtgattttgttgcttattgtattgggaagtaaagtgtaatacttcatctccttgaatttggtctagccttgtgatttgttttggctagtgggaatgagaatgtggaagaagtttggatatgggatttctgagcacagacctcaagaagctttggaactttagctcccactctcgtgctgctatagactgccacgtgaggaaactgagactagccttcttaaagatgagaggccatatgaagagacaggaccaatgaagagccaacaccaactataagacatatgactagcccagagtgagcaattaaatgactgcagctgcataagtcactgcagcgaggacaaacagaagaacgagccagctgaatccagcccaaattgctaaaccatagaattgtgagcaaataaattgaatgcactgttttaaataaataaacaaatgcattgctttaaggcattcaaacattagaatcatgtattaaacagcagcaacaactcacacaaaaattgatatctaagattatgttgctgctgtaataaaaacataaaacatatgccactgaccctgggatttggtgttgagtgaagcctggaaaattgtggaggaaactcactgtaagtgagaggtgacagcgtgtggcagtcctcacagccctcgctcgctctgggcgcctcctctgcccgggctcccactttggcggcacttgaggagcccttcagcccgccgctgccctgtgggagcccctttctgggctggccgaggccggagccggctccctcagcttgcggggaggtgtggcgggagaggcgcgagcgggaaccgcggctgcgcgtggcgcttgcgagccagctggagttcgtggtgggcgtgggcttggcgggcctcccactcggagcagctgccctgccggccccgggcgatgaggggcttagcaccccggccagcggctgcggatggtgtacggggtccctcagcagtgccggctcacctgcgctgcgctccatttctcaccgggccttagctgccttcccgcggggcagggctcgggacctgaagcccgccatgcctgagcctcacaccccctccgtgggctcctgtgcggcccgggcctccccgacgagcgccgccccctgctccacggcgcccagtcccatcgaccgcccaagggctgagcagtgcgggcgcagggcgcgggactggcaggcagctccacctgcagccccggtgcgggatccactgggtgaagccagctgggctcctgagtctggtggggatgtggagaacctttatgcctagctcagggattgtaaatacaccaatcggcactctgcatctagctcaaggaaggtttgtaaacacaccaatcagcaccctgtgtctgctcagggtttgtgaatgcaccaatggacactctgtatctagctactctggagggaccttggagaacctttatgcctagttcagggattgtaaatacaccaatcggcactctgcatctagctcaaggaaggtttgtaaacacaccaatcagcaccctgtgtctgctcagggtttgtgaatgcaccaatggacactctgtatctagctactctggagggaccttggagaacctttatgcctagctcagggattgtaaatacaccaatcggcactctgcatctagctcaaggaaggtttgtaaacacaccaatcagcaccctgtgtctactcagggtttgtgaatgcaccaatggacactctatatctagctactctggtggggccttggagaacctttatgtccaccctctgtatctagctactctggtggggacctggagaacctttgtgtctagctcagggattgtaaacgcaccaatcagcgccctgtcaaaacagatcagcaggatgtgggtggggccagataagagaataaaagcaggctgcccaaaccagcagtggcaacccgctcgggtcctcttccacactgtggaagctttgttctttcgctctttgcaataaatcttgctactgctcagtctttgggtccacattgcttttatgagctgtaacgctcaccgcgaaggtctgcatcttcactcctgagccagcgagagcacgaacccaccagaaggaagaaactcggaacacatccaaatatcagaaggaacaaactccagacacgccaccttaagagctgtaacactcaccgcgagggtccatggcttcattcttggagtcagtgagaccaagaacccaccaattctggacacataagcaggaaaagcaagggggaaacatctaccggagactagaaaatggtgacttatgtaatgcagtggcaggtgaaacgataacctgaagttacttaaaagacagaaatgcatttaatgcatgtgtggatctaaacaaggcaatctggaatagaatattgacaatgttggtttccaagcagagtttagaggaaatatagagggcctaggactttctggcttgtaaaatacaactatttctcgtcccctattcttccagctagcaaaatattctcaacgtaagaattagtgtcagtaaaggtcaaatcatgggtgtggctctatgatactttagtaagacctcagacagatttcagaagaaggctggtagaccctcacagcttgacaaaagaattttaagactattgcctcccagctgcctgacatgaccaaagtagagacagatctgtcttgagaataattgcacacatggctttgaggatttagagtgtcacccaataagatttaaaggaaatccacaaagttttaaggagaattgtatttatgaaacaaaacactgctagtttggtctaaaagaggctgagactctccaggctcttcaatgtaaaagatggcccctgagctcataactatgggaagaggaacgatgagaaacatatgtagctgcaaaatagaccctttcatatagaaagggcctactgagagagtaaagccagacactcagacaacattggactaaaacactactcctaggtaatgtaaacagatcataagcaaggagcattctctgcatctggaggaggagaaactaacaataagtgtgtgcctacatttcaaaaaaatctatggactgatgattgttatatgcttctcaatcttcctcttttaaatggagtttctattaagttatcctatccctgtctcaccatttgtattctggatgtatggaggcattttacgtgtcttttaagttcaaaagtctttttttgagttcagaagagatgccgtagaggaagagctgtactctaaaagccttgtcattatcaggcctggatgcagatcaaaagatccaaaaccatgagcctgatgctgcaatcgaatgagagttttgagagtcctcaggactcacgagcatattttgcacgtgaagaaaatgtgaataatttgtaaccagatgacatattgtgctattaacaaaaatagccacaaattcctcccattcatatacgcacacccattgacactataactttttttttctttcttcaagagatggagtgtatttcttcctcacttacaatcagagtttgtcttagaacttctttaaccaacaaaatgtaatggaagttatatttagggaatcatgtgtacggtattaagaggctttgcagctgcactgcccaagagttagtgaagaatccggagctagcctccttaagaatgcaaaaccacataaagaatgtccaaccaggccaggcacggtggctcacgcctgtaattccagtactttgggaggctgaggcaggcggatcctgaggtcaggagttcgagaccagcctgagcaacatggtgaaaccccgtccctgctaaaaatacaaaaattagccaggcagctggcgcacgcctgtaatcccagctactcgcaaggctgaagcaggagattcgcttggctgaagcaggagattcgcttgaacccaggaggcagaggttgcagtgagttgagatcacgctattgcactccagcctgggcaacagagggaggcttcatctcaaaaaaaagaaaaaaagaagaaaaaaaaagaatgtccaaccaatgtcttgtcttgcatgtagcacaaaatgtgaaaaaaaaaaaaaaagaaagaaaaggcatcttaaaacagcccaagttaagcttccagatgactaccactacattagtaatatgggcaggacttgcagaagaatcaagccaaactgctgacatacagaatctcagcaaataaaagtgttgtttaaacctgtaagttttgaatttttttgctagagtaatagagaactgatacaaccccaagtgcagccaatatataatttataaacaaaggaaaaatttaaaaattttcagaaaagtaatgtaagcaagaacgaatcaacagaatattcttaacactgacaattctaaataaatctagattaaaatataagagatgcaggaaagatgaagagaatcaaagggtgaataggtgggtaaatataaatgcgtaataactacataaaacagtagcaatagttcttcagtgtatctgatagatacataggaaaataaataggtaccagttagatagatagagagagggagaaagaagagagatattagaatcacaattctaaaagcagtaagtttgaaggagtatatatggagttaaaatattctaagtgtcttgagttactggagaaagcgtaaaagttccagggaacattaaacttaatttatcaaggatgcatttgtaatctctagggtgactttaaaagaggaataaaagaagacacaactatcaaactaataaagggagaaattgattgataaaaacaactattccaagaaaagacaaagagggaaagaaaagaacatacagcaggcaggacaaataataatgtggtggagtacattgtttaggatggactagcaagtggaagagggtatgaagaagctttcagggtcttgaaaatgttctatttgttgataaacttactagttgcacaaatgttcaatttgtaacaatttgttgatctctacatttatgtttatgcaattttcttttctttgtttttttcatttttatttttaatttatttatttatatttttgagacggagtcttactctgttgcccaggctggagtgtagtggcgcgatctagactcactgcaacctgtgcctcctgggttcaagcaattctcctgcctcaggctcttgagttgctgggactacaggctcatgccaccacacccagctaatttttgtatttttagtagagatggggtttcactgtgttggccaggctggtctcgagttcctgacctcaggttatccacacacctcagcctcccaaagtgctgggactacaggcatgagccaccgcacccagccaattaatgcttatgcactttcctatatgtgtttatttcacaatttaaaaagttaaacacacacacgcacacaaacatgcccaaacaacctacctaccctataggggtcttaaaaagataaattgatacagagtatataaagattaaacttatcatctgacacatcaaaaacactaaataaatgtatatttgctattactatcattattagttttctgtatcttgagcaattcaaataaaaatatcaataataattgttaactttacaaaattagtctaatatttattccaaagaatcaattgacaaaaatagccaataatttacagtgaaagaagaatcaaaaggtttcttgtcctaacaaatattttaaatatatatatataattagtaaacatgacactaacatatgtctacaagaatataataacttggatatatattaaatgcatgttatattttatcaaataagaaattagcatttcagattcgttgaaaagcaaattacttagaaaaatagaatatacatgacttgatgtcgttttaatttcagcagcaaatgccttgttacctgatcccccaacccctctcttgcccttactactgtctcatcagtttgctctcacggtactttaatgagagtaatgtgactctcaacttattcgcaagactcttttctttgaagagttaagtcacccgtttatttcatacttattcctcctcaaagcaggatttttaagtaaaatgtttccaggcaagtgctatttcttgagagcttgtttggaggttctagcaggggaatgcagctactcgtatacccttgacggaagaccggtcctcctctacgtggtatggtcatcctcttccaccaagtgcacagcttctggagggacacacatggagccgtgaggaaggggacacccgcctagccagccatatcagctgaatcaaccctggtgataatggggtgacagatgttgcaaccagattgccctcacatccgcaagtgctatttcttgaagttattccttttagtatcttgtgttccttttaattagcacttttttcataaaattcaaaaacacctttatttcttttgcaaaagtagaattgatattgttatggctaaaccaccatatacaatgatattggtacaaccagttaattgcttagttaaaaaaaaacaaaaatcaccaataaagcaaaagttattgccagaagaattaaagatgactatttaaaaaataaaagcataaatatggtaggagaaaagataagtggctatttatgctccttgaattgagaatagtttttttggtaacagctctgttaagataaaacacacaccacacacacggtttttagtatattctcaaggttgtgcaaccatcactaaaatcaattgcagaattctttcatcactcaaaataaaacttgtacccttcagctatcattctcctagctccttgtcttccccaaacccccagccgtaagtgaccactaatctactttctgtctcagatttccctgttctggatattttatataaatggaatcatgtaagatgtggtctttttactgccttatttgagttagcataaagttttcaaggttcagacacattgtatcatgtatcattaatttattactttttatagccaaataatattccatggtatgaatatgccatacttattcatcatttgatggatattggggttgcttctactttttggctattgtgaataatgttgctttgaatattatgtacaagtttcattttggttactctacttttaaactccagaaaaatcactggttgttttgaaaataatttctatcactttatggacattctctatttgtttttgttggtggggttcttttttgtttttgaaacagggtcttgctctgttatccaggctggagtgcagtgggacggaccatcatggctcactgaagccttgacctcccaggctcaggtgatcctcccacctcagcctcccgagtagctaggactacaggcgcgccaccaaccctggctaattttttatgtttatttttagtttttacttttgtactgatagtggtctcactgtattgctcaggctggtcttgaactcctgggctcagcaatccttccacctcagcctcccaaagtgctgggatatcaggtgtgagccacattctgatatgaatgtcaaatacagctgacattctgtatttgaagcaacatggttatcatgtcttcttttacttttttaatcattctttcctttagttctgtgaacatatttataatagttactttgaaggttttcttttcttttttctgctgaatctgacatctggtttctctcacaggtagtttctgttgcctgcttttatttttctcttgtatgagtcacactttcctgtttctttgcgtgtctcataatttgttgttgaaaacttaattttagataatatattgttacaactctggagggcccccttctgcctcacatgtttattgtagtttgcatgtttagttgtatagtcacttgctgggctgttagaatagggtctatttccctcacagtatgaagactctgattttgctcctcagagggtgcaggctgacatgtgcacagtcagcctccaatacagtgcttttagaagggctgtcttccaggctctttttccatgatcatacccagctgttaagctctactaattcccaactgattgatctattgtttatacaatgccctggagcataaattgctccctagactgaaaacaattcaattaaacttgggttcctttatggggtaattttgagatgaatgtctgaggtttgcttggacccaaagaaggctcttcttagctctcttttttttctctcataagcttactggtttgtggtttaacttaaatccctcatgaaggtaccatcctcttcctaattgctttctaccaaaacctcctttgattttgagatccttaaaattgaacttctctacactccgttgaaagtcaagtcagtttttttgtttatttttttgttttcttatggcctatctcttcccctggaccaaatctctgagccatggctttggaattagttgtggggacagtcatatgcttctctctgatgacaacctagatttagaaggaatcttggtgggggcagcagcctctggtattctaggcgtacctcttgacacagaaccttctccttacaaattagctatgtttagggcaattggctagaaagaatctccctgttctatgaatgagggctgagtgaaagaaggtagccttgacctcctggccacactctcctgatatttagcctctgcaacaggtaattgtggggaggacaggaaatgctaaaggcatgtccttcccagaaagatgccacattccctttactgggttctggggttgcctggggagtgaagggtactactatgttattggctgtgctcacctggagtggagtttctgccgtgctgagctggcagggagaaggttgtggaacaaatgccacagactctcaccgttcttgatgagttttactagattttcttgaataaatatttcttcattgatatatatgtccttaaaaccacttccagagtttttaaatgtgtgtgtgtttaaataattttcacctccacttagcttgttttccttgggagtgggtccactggactccttacattttgattccatatgtcagaacccaagaatatactttaaatatatgacaccaaagatagaaatgtaaagaaaaactactaaattgattatataaaaatgtaaaaaatctttctctctctctctctttctttcttcttttctcttgagatggagtctcgctctgttgtccaggctggagtgcaatggcatgatctcggctcactgcaacctccacctcccgggttcaagagattctcctgtctcagcttcctgagtagctgggattacaggtgcctaccaccgcacccagctaatttttgtatatttagtagagaagggggtttcgccatgttggccaggctggtttcaaactcctgacctcaggtgatccacctgcctcagcctcccaaagtgctgggagtacagatttctaaagttaaaaggcaaatagaaagaaatattttcaacggataaaagtttactaccttaaatattctgaaatctttgactaatctctaggataaagatgaaaactcaaataaatgaataaggaacacagaggcaattcataaaatgcatataacacataaacataaaaaaatctttaacctcactagaattttttaaaaaaggaaaacaagaaacactttatgtccacaaattagaaaatatataaataaacttacaatactcagcaaagaactgaaaaaatacactatgatgagagagtaaattgacacaaactttggcgaaatgaataaatatcatattaaaaacatatataacctttccatgttgcatttaatttatttaaagacggtatatatagtgtgatgtatggctgatggctgtgtgcgtgcatgtgttttcgtgtgtattgtttttaacctgtaagggtactgctgttaacatttgcagagccctaatcaggaatacatattgcagagggcaggtagcatctgtaaacgtcttatctgaaactctcttgagattcaattaacagcatttactatcaacaatacaagccttgctaattggcacaattgaacatagcaatgattattatcactggtgaatgattattttctctggtgaaaagattggtgtttaagatatgggtctggctagaaatactgcacagtgagttttgcccttgcatagcacagaaggaaaatctggtgagccgaataacttataatcttaggaatgatgttttgtgattttgattccgatcagttctgtgttgagcagttttcagaggatttttttgcctgactccaagtaagactttaattgaatcctgcccttgcaatattgtcgcatttgcctctggtgaatctttgattcaaaaggctattggagaaactgtaaggacagaggagttgggactttattgagcttacagtttgaatagctgctttttaatgtctgctatgttgttatgtgtgcagaatttagccttgaattatctcttcttacaatttactacattattttgagggtgatgaggatgaggcctagagccctcattacctctaattgttgatcatggatatctaccagaaagaatctaataattatgaatgaggaaagtcacaagactttttgatatggtttgactccctgtctgcacccataattctcatgtgttgcgggagctgcccagtgggagacaatcgaatcacggaggcaggtctttcccatgctgttcttgtgatagtgaatgtgtctcaccagatctgatggttttgaaaaccagagtttctctgcacaagctctctcctgtctttgctgccctccatgtaagatgtgacttgctcctccttgccttccgccatgcttgtgaggcttcccaagccacgtggaactgtgagtccaattaaacctctttcttttgtaaattacccagtctctggtatgtctttattagaagtgtgaaaatggactaataccctttctgacctagtagatcaagttctgggaatttattctgagttaataatttaaaatgtgtgtaaaatttaacatcagtgtatttatcaatgagttatttatcatagcagaacacaaacaacttgaatgctcaacaatagagaactgattatctgtagtatattctgaaatggaatattaagcagcttttaaaagtgaggggatatataactattgaatgatagagaaaagttcaggacacattgaatatgaagaaactgatattaaaaacatgaacaaaatgaaaatatttaagaaaatatgtaattacagttatgtgaatacaatgtaaattgtttaggataagatgaaaagataaatgatttgatgaattctgtataaattgaatgtctctaaattgaatcgcataccatatgggcggatgtggccgtttaaaggagacatttggtacagttgaccctcattattcacagataacatatttgtgaatttgcccacttactgaaatttacttataactccaaagtcaatacttaaggcacttgagtagacacttgtagacgcacagaggtatttgtagatgcacagagaataaaaattgtagttgcccaatgcacacattcccagcttagatcaaacaaagtgatgctctgtgttcttgtttcagctctcatattctaaaaaagtctcctttttgcagtatatttagtgcatgtttctcaaattttgggtttttctgttggtgattttgctgcttaaaatggcctcgagcacagtgctggagtgctgtctagcattcctaagcaaaagaaagctgtgatgtgcctcacagagaaaatacatgtgttagataagttttgttcaggcaagaattacagtgctgcaggccatgagttctatgttaatgaatcaacagtatatattaaagaaggtatctttatcagttgatgaaaatcttgttaccagaggctgtcaggaacataaccctttattgtctccagtgtttgcagtgactttatagaacataattactgaggacatcagaaatcaactataaatacttttgcaactaatagacctttggaacaattatttttggattttgtataaagaatccaaaaaaatctggaaaacgtgtggctaagaaaacagttgattggtccctaattccaccttattatgtttaaattcagtgggtgtctcacagccacgtttataaaggaatcttggctggggtgtcaggtttctagtttactttgactctatctgtcagtctgtgtccaaccttcatggcaattaactgtgcttttgtgtgctaattatcattatcccagtatgggcccattattagtccaatgtccttagtttaaagcttaagtgtcaatcagtcacctaaaacaattgcatagaaggaagctttgcaaggctggtttgaaagtccttagctgagttctactttattatactccagttcgaaactgaacacaaagctcttcttgatacaattgtttatttaaatactgatttatctacttaattaaagcaaacttgagtttatattttaaaatcagggatgggataattgctactttatgcttgaagatctattcaggtagctatacattaaacaagtaaaaccgtaattataaaacctgcacatttttatctgattgagtcgctcctgccattgaacgaccttattcaagtcatttagaacaaagaaaggtggcatatatgagttttttaaaatcccactggatgccaggagtaaggagaaaatagcatcaaatcagatgtggtcagaaaagaggtatttcttttcctgtgatgcttttcctctttcctcctcttacagtaaatccccacttatcaaatcttcagatgtgtagagaaggaataaggcaggggtaatgggggagtgggacagagagatgccctttctggagtttgcacaacggttgcatgctgagtaaaacctgatgatgtattccattcatgtctccaaaaagtcaaaagcggtttcagcgttgatttcccttaagagttatcagtcctcattcaattggtttaatgagtgtaagaggtgaccttgtgtctatgtagatactcccatattaaaagacctggatgtaaaacttcacatatgtgtaaatagttattttggagggtgttgtgagggttattgcagctctctgctcagctgctactcaggctaaacgggcaggagaaattttccactgtgttagaatgatgattatttgcaaattacatgagcaccagtaattcattcatgcaatgatacagagctgggtctcagtgcagtggtattgaacttgctgctgggggcgttaattgattcgtttggaacattcccctccagagaatcccaatcacaggtcccctgatcaagaaacggacacgcagtcggggtcctggatatgtagagacacacgtgtgaggctgttgtcatcaaaataaaccatttctgtcccctgacaggggttgagtctattaggaacactccccaatcctgggagcttccgcaagaggctttctatcttggcagaggtggcagctgagcatcgcttctttgctgcaggatggaaaaaagggactggattattggctgcattttaaactagctgctgttctagagaaaatgttggggagggactgaacaagcttagcactggatcagtgtgggggtgtgttggtgaaaagaaaaaatgcctcctcctaacttaacgtttaactgatatcccctcaacacgacccaaatctgtctctccagatacacaatgtctgttttcctaactacatggtgaactgtggagcaagtcttggtcatgtttagtttgtttcccagaatctactagaagacaatgcctagcatatagcaggcacagaataagggccaaaggggagaatggaaacaaaatatgtacatttgaaatttagaaacacagttaagggactttgcctgaaattgtcataaaactttgaaaattgcttcaatgtatagtcccagtgggagaatgtgacagcatattttattctttgttcttttctgaaattctgtgtccagtctaaaacacgacatttccctttaatgtgttaggagtatgcatgactacacaggaatattttctggagaacttctggtgaagcatattttgataaacagtcttactaaaagttatatatatgtacttttaattgactagttgcagagaaataatcaatgtaaaaaaaaatcatacatagtacaggtagtaaaagtcacagttccggcagaagcacaaaagccttcaaagtgagtgggaacctgggaaccattgatcctcagtggctgtttaccatggaaaacacctgcatcaccaacattccagttttgcaaaagtacctctattacagacacataccaggcaaggagggaggaaaaagcctgaaaatttctctccaagtttaagtaatcaggaaactttggtggggaggttggggtggggtgggggcgggggggtaacttctttatttagcattaatctcagcaatcatgaaagtcatggaatttcaagtgatgaaaaatttgaccacaacaatacctatcactagcctggttttgcccacttctcgaacaggaattataaagataataattaattctaaaaagcagaagacaaaacaaacaaaccaaaccaacactgaatgaactaataaggctgctgcatatatatgttggagttggatgtttatttgcttactgcagtagtttaaaaatagttttccagttaacatcttttccacatagtggagatgtcagggtaggtttacatgattgcgtaaatggtcagaagttgtttatgtagctctgaactgctgagagatgagcaggaagacctgggttcagcaaaacccttggggctttttcccagagagagaaacagaggctcctctctgggttgctggaatgctttccagacgaattcgactgggttggcttttctctgcctgtcaaagtcactttgcacagtgctggtgaggggctggggcattgctgccaatctctacggttaccccgaggtgtggagttgcggcgaagggagccacttctgcaaggaaacagtagattcataatgtagaatgaccgtggcaacgtcgttcaaagcacattctttcgaataacaaggctttcgacatgccccacccccgcgcacaacacaccacaaattgatccttgtacctaatttacagcaactgttccctctgacctccccccgcccccgccccacattccaacctgaaagcactttgcgtggatgagacttcaggtgtgtaacgcagcctgtccagccagtgtcctccgcctaaggacaggcaggtaaaaacctaccaaagccccctcttctggcctaagttcaatgccacccgcccacccacattccccggttcagcaattttcagcccagacgcagaagcatctgtttccctggccagggcgccttaacgatcccccgaattccgcgtctcccggaggccagaggtttgggtacccaggaaggtcgcgcctcctcgtgccccgatactcgggttgtaaagggaggagacatcgcctcggcgcatccctggccgctgaacaacgcaacccctacgtccccgcacgggaatccggctgataatctcctcttgcctgagaatcgggccaggcgccctttactaatttcgcgcgctggggacctggggctgccgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagcgtctcccccgccccgcggctaaggagccggcagcccgaactccggcgcgccaggtttttccagccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaacttctggggggtttccagtttctttcgagaggcaagacaaccgccccgtcccctccccgggcccagacggcggcgaactgtgcgccgggcgccccacagaccccaatccactcactctccttctggaacgcggggctcaaaatcttcgtgcattttctctcttgtgcttcgtgtatatgttttactatttatgaagggtgtggaggtgagggtaggaggacgtgggctcctgaatccctctgaaccagccagagagtcggctgcatggaaacatttcgcagcgaagctcctgcgaggaggcggcttcgcgcgtcgggaagatcaggcggttgcttgctggccagggtctgcagattcggtgcgaagaagctggcggaggttgtgtagggcgagtcagtgtgactgagcaccctgggtgtgtggtctgcgtggaggagagtgggccggatcttgaggtgtgttggaggtttatttgtaagaggagttcctgaaaggaatgtcgtggaactttttctagttttcctgctggaatcaacataggggcgggcacatgtttgtcagaataacagtggcatttaactgcatgggaagctctttcaattttctgtagtgggagctggatagttcaaggagtaactccacataactgagtcgtttggatacccacacaagataatttggaacgcgcttgtatttttttgttttttgagatttctggtttatgtcctttagagagtggggtaggagcgtaaagactgtataggttgcctatgagcaggtccatacaatagcgttcccaagtctgcctaatagcaagtttgttctctctttctctctctctacccaagtgggtgaaaaagaacagtgtgtcatgaagacaggcacctggaggtgatttgggtggcattcatgagaaaattcacgttacccgtaagtttattcttgctatttttatcttgatttctttaaagattttgtgggaatatctgcagtgggtcgcaggagtaggtaagattgctaaggatcaaaaacaagtttcatgagaatattatttttgctaccttataaaatagctattgatttgtttgttgaagctggtttcaactgctctgtcttgttgaggagagatgatgctgataaacgtcattatttttccatctgaaccctgggaggtagctggcaaggatggaaaaactgaccttttcaattaaagactaagagtctaagagaagtgacttggataagggtgcatgtcagagccacatgtaagtttcaacagaggtagattttcctatttgcagttttttaaacaacacttttcagtttctttgagttgtaaaacttttcaagtcaattgggagtcaatgcagtacctttttccatggtcatttcatattggcaggtaattaagagtgattagagaacaaacctttcaaatgatgttggattttttatcattcacttattttacctacttctctctcctttttgttcaaaagtaggtcttctgatttcttttccgatctaagcactaaatcttttggctgcagtttttcttctgaaatgtatacagggcatccgttccttcaatttaggtcttaaaaaaataaagctgctcagcagaaaattcccatgcatggtactgacttttctacaagtttgtctgatcatgattttaacttgttgtttcttctttgttatatttgaggacagacataatatgcattagcttcaatctctcttatcttaaaaattaatattttgtaaaaacttgcttttatattattttagttgaataagtctatttcatatgataggcagggggaagtctctacacactgattttttttgttcctttttgttcatttttccctgtaatgctatgttttaagcctagtgaaggaggcaaggaggcaggatttactgcctagatttattgatcttcattattattattatttactatcagaagaaatctgacaacatatcaataaaatttatttataaactgaagacatgctgttatatgatacactacttataaaacacacaaagaaacaaaaaagatgaataaagcaaaaattatgaaatagaaggtctcatgttgctgttatgtatcccggtggatcattttgtacagcccctggggtgtgtagcacactttaaagatcactgctggtttgatatttttaaaatctttctctccttatctctgctctgctgttcatcatctctgatactctagccagttgtaaaactgctacacttctatatcttctgtaacaaatagattaagcacacttgttttcctctcatggactcatatgtggatagaatgaggtgtaaaggatgaatgtgttttggagatgtcatcttagatctcccaaagtagacatacaggtgaattttaaaaaatggagttttagtttaaagactaagtaccaatggtcaggaagtgaagaatccaaggagtaaatgagggaggattggaaggacactttccacattgcagtgttgtgtggaggctggaaagttcataaaccttgaagcagattaacctgaatctaagtctggcaccatcatttattacatttacagtcctgggcaatgtagttccttaatttctgtgagccttagtttctttaggtataaaattgggataacatctatttcacggcatcacgatagggattaaacatgagagcatgagtcaacatgggtcaagagcttggctcttttagattggctctttagcagatataacagatccaaaagggatactgcctcagatgtgaaatatatttatttctcggttgtgtgaagtcccagaatgggtgatcatggcagtactccttcaaagtgtgattcagagacccagccttcatctgttctgtgcccttgccgtcttcagcagggtcactgtgcttacttgcatcaagccattggaaagaggaagacttgggaggatgttaattgcccagaactggaatgagtgcatattacttttccttgcattgtgctggccagaacccagttctttgtggatgtacgttactattaaggaggctgggaaatatagtctagaaatgttatccaggaagtagaagaaattgttgggggaacaactagcattctctgatgttttattactatatgtgatatttcttccatgttcaataactgttacttccttttcttctcctaacccttgcttttttttttttctggtagaaaaactggaatggatacaataaataataatagaagcagttaatacatacataatgcttactattattgagatactttttaaagcacattgccctactttgcccttctaatattatctctattgtacagatgaggaaaactaggcatagagaaattaagttatttgttcatcatagctagtaagtagcagagctgggatctgaaccaggttctctcactccagaattgattttttaacagctttttttttttttgcttttgcctcaatacttttcttatttaagccactggaccgctttttacttttgcctatatataaaaaagttgccaagagaattttttaaaatactaaagtagaaaaaaaggatataatccaaaacatactggaatggaattagatatgatacagctttatcttgaatacctaccaggatcaggagcagatatttaaagtaactccccccacttacacacccttcaccactacaactgctctttcatttgtgataaacacattttcagggtctgtgccttgaattataaccttcctctgaagattctattgtgggagtcttgcgctaccactttcatgcttcagtatgtgaggataaattcctcttcacttctcagcagaaacaaatatcttccctggcaggtttttcagctaaaatagcctctcctaacttttgatcaaaggtattgctctttatcaatatccccatcctccaagaaaggaaaccctcttcttttcctatgagctttgcaaaattattttttatttatctatttatttatctttattttctatatgactaaggggactgtatatatatcccaggtaccgtctaaaagaaaatggtccctcttgttctcatcctgttgtcccatttccattagagaatctgcctcatcttatgtttcctatgtatttgtctttcataaaaatgcctgttagagttttggttcccagtggctgcagtggaaatgtgtagtggtcaatagtaagcgtatactttttgctaagatagttattgtttcaacattaaagagtgatttttttcctcttgttcagtatgtatttgttgcatcttcacaattaggtaatgatatgtatcttcttaccatgtaggtaggcataaatactgtatacctaccagtcatttctttcccagaagcccctgttcatttcctctttactttccctgagcctcacatcctgagaattttgcttttttttctgaactcctctttcttccaattttttccacttctgtgccatttatgtctacgtgtgtgtgtgtgtgtgtgtgtgtgtgcgtttcaagtcccttcttatgatttaatggggttggagggctggagaggttttcatgtgcttactgtcatgttttcagccaaattccacagggccttgtaacaggctaacatgagcagataagctcttaattttcagtgacttattttaactttttacttcttgctcatgtgtggtagttcagtactcatagaatagatcctgactgagtggctgtccatggggtcattcagggaatcaggttccttagagttttatggctttgttcatctttaagtacctagagtcctcatcattcagtcaagatacagagtgtgaggagataaataatccagagaagtcttattggaggttgttgtaggcacagcctggaagtggttgtcatgacttctgcccacattcctctggggtggacctcagtcacttcgacatcctttgctgcaagggaagctgagaagtggtgtctagctgagtgcctgggggagaagggtgaaaggaaaacaggtttggtaaataactagccagtctttgtcacaggtttccaatgaaagcatgtgagaaaatcagctaattctctaggtatggggaaaagagagcatggattttggttatttgccaaataaatgcccattgccttgcttccttttaattttgacctctattactatcccattcttagtgcatatggtctgggtgggattccgtttcccatttaaggattggagcatgggaaccaggtcttgtcgggaagagcattgacttttcctgtccacagtaattgcttctagaacagaacaggcatggacccagtgagaaccactgcagtgagatgctttgctttttctcagtggctctagttgggctccatgtatgcctttgaactaattcctgtagataaggagattagaaccagggagcatgtgggcctgccactgctgcagctgtcttaacaccaaaaagagaacctagacctgctgaggtcaccacatactacttgagaatgaagccaacagaacagtagcaaggggcatgatggagcaaaaccagctcctcttgcatcatgtgagcccgttaatctggctatgcctaaagtgagttaacctggtatattagtctattctcacactgctagaaagaactgcctgagactgggtaatttgtaaaggaaagaggttcaattcactcagttccgcatggcctcaggaaatttacaaccatggcagaaggcacgagagaagcaaaggcaggtcttacatggcggcaggcaagagacagtgaaggaggaagagccccttataaaaccatcagatctcatgagaactcacaatcatgagaccagcatgggggaaactgcttccacaatgcaatcacctcctaccaggtcccacccttgacacatgcaaattatggggattacctttcaattgatgagatttgcgtggagacacagagccaaaccatatcattctgcccctggcccctcccaaatatcatgtcttttcacatttcaacatgccttcccaacagtcgcccagaatcttaacccattttggcattagctcaaaagtccacagtccaaagtctcatctgagacaaggcaagtcccttctacctatgagcctgtaaaataaaaagcaagttagttaattccaagttgcagtgggagtacaggcactgggtcaatgttcctattccaaatgggagaaattggccaaaacaaaggggctacaggccccatgccagtctgaaaccaggcggggcagttattaaatcttaaagctccgaaatcatcttctttaactctatgtctcaagttcaggtcatgctgatgcaggaggtgggctcccactgtctggggcagttctgcccctctggctttgcaggctacagctcccctcccaactgctttcatggctggagttgagtgtctgctttcatggcacacagtgcaagctgtcagtggatctaccattctgaagtctagaggaccatagccctcttctcacagctccattaggcagtgtcccagtggtgactctgtgttgggagctccaacccccatttcccttccgcactgccctaacagaggttcttcatgagggctctgccccttcatcacacctcttgcctggacatccaggcatttccgtacatctactgaaatctaggcagaggttcccaaaccttcatttttgtcttctgcacacccacaggacgaacaccatgtggaagctgccaaggcttggggcttacaccttccgaagcaacagcttgagctataccttggccccttttagctacagctggagtggctgggacgcagggcaccaagtccctaggctgtacacagcagggagcccagtgccttgtccaagaaaccgtttttccctcctagacctctgggcctgtgatgggaggggctgccgccaagatctctgtcatgccctgaagacgttttccccattgtcctggctcctccttacttctgcaaatttctgcagctggcttgaatttctccccagaaaatgggtttttcttttctacagcatcatcaggctgcaaatttttcaaacctttttgctctgcttcccttttaaacataatttctaatttcagatcatcacactcaagtttaaagttccacagatctctagggcaggggcaaaattctgctagtctctttgctaaagcatagcaagagtgacctttgcttcagttctcgataagttcctcatctccatctgacctggacttcattgtccaaatcattattagcattttggccaaaaccattcaacaagtctctaggaagttccagagtttcccacatctttcttctgagtcctccaagtctctagtaagttccaaactttctgacatcttcctgttttcttctgagccctccaaactgttccagctctatctgttacccaattacaaagttgcttccacattttcgggtatctttatagcagtaccccactctctgcagtaccaatttactgcattagtctgttctcacattgttataaagaactacccaagactgggtgatttataaaggagagaggtttaatggactcacagttctgtatggcttgggaggcaacaggaaacttaaaatcatggtggaaggggagagagaagcaaaggtatatcttacatggcagcaagcaagagagagtgaatgagcaaaggaggaaaatccccttataaaacgatcagatctcgtgagaatcattcactatcacgaaaacagcatgagggaactgctcccatgatccagtcacctcccaatcaccacccttaacacttgggaattatggggattacaatttgagataagatttgggtggggacacagaaccaaaccatatcagctggtgattttgcagctcttcagattcataaattaccctttgacgtaagctgatttgggttggatttgtatgacttaaagtgaatactgatttattagaccaagcaaaaaagaggaaagaatactggataaggaagggagtgggggttttatttgtttgtttgttttcctgagctcatcttatgtcactttggttgtgtgcctaacagtttcactcccttgtaatacatcagacttccagtcaagaaccatttggcatacccctacccaggcacatagagctctcactaaattataaacccgaagctgttaattcttctcaaagctgatctctccttacagagttatggaagggaaatggaggtgaaatcacatcctcaggcttaattccctctttcaagattgcctgtggtccctcctggatgatgctttcttttccagcatcacttccctgttcctatcctcccccaggcttgcagaccaactgtaacaatctaatcacccatcctggaacttttcatgtgccttttcttttttttttttttttttcatgactgtttacattgcctctctctttggcctcctcttactgtccttgtctactgtgtttattacagtttgcacaatgctcaactcaagtatcactaagttaagcctctttcaatactattgaggcataaagaatggctccgtcacctgtacatactctcattgtacttgtttccatgccactgatataatatctgtcatgagaatgaccatctctcttgcttttcccaggacaggggggttcccaggatgctggatattcatttttaaaaccaggaaagtcttgatcaagccaggagaaatttgttgccttgccttctacattgtaatagctctcatttaacatgccactcggtgcaatggaatttcattgagacagtggataacagcttgaaatttggaggcaaaattcttaccaatcctagatccattttgtactagttgtgtgattgtgagcaagtgacctaacttttctaggttacagtttcatcatctgtgtagtggaatagtatgtgttttgtagggttgttagctaattaaaagacatcataaattaaatcacttcgtttagtgatggacacatctataacattgtctaaagcacacgagttttgtgaagattatgtagagtactacatgcaaagtacaagcaggacagtgcccaaatcctagtaagcatccagtacacagcttttgttatggattgttgttattcacttttaagtatctcttgcctaaaacatagtagatgccaaaaatacaattacactcagagaatacatgttcatggagcataaacaatgttactcagagtttgtgataagtggggcaagcaagtcagtgagagtgattaggaaatattttcgataattacttggtctttgaaacttgaaaaagctggaattgactgcaggattagttcctttttagaaacagtttgttttttcttgcatatttaaaccagacttcacaaattttcatagttcggaaagagaaaatattttccatgtttaggcaaggtcagtattggtgcataacccctaagtacatattttcattatttttattaatgaaataaaagtggcgcatttgggggaccaaaatgcaaatattttgtctttcttttggttcataagaaagtgaaggttagggcagtagaatcactactccattattaatcattattccataatgatcttgagttaaaaaaatcatatgatttgttgttgttgttgttaaccacagtgacatatcctctctacctttgggctgaacttttgtatataaaaatactttgtaacttgcacacttgtattaatataaatcttgagtgtccatgttgcctatgcctttcagttttgtcatggaaatttccagtgaggacaggtgttgcatgtgtgcttatgctgagatgggtccagtctggacaagaagacaatcaaacaaaacaatgatatgactcaaatcaccaagtatgttttgtaagatttgattctaggcacattgtcatcattttaagttgtgcaaatttgtattgttatccatattatgatgggtcttcaactattaattataaatacgaatttttttgtctttagtcactcatttgattagctattagctagatattgattctagactccttacagattagtgaattaattgggagtccaagcattatttttagtgtatttaattgggtgaatgacagctttatagagaaagtgattacttaagttgcatatctaattcttagtaaaaaattatagtacaaacaaggtcatctagaattcttggatctaagtaatggtaaattaagagttgcttttaatataatagtatcttttaaaaatggatatccctgtaaaatgtcttcattttctgcttaagcaggtgactaaagataatttacttcttgatgacacgggatcaccatgataaacatagtttggtggtttagaatagagtatgggccttggaatcagacagacctggtttgaatccttgttttgtctcttactagctgtgtgatctcaaacacattcttacttttcccaaggcagtttttaaaatctgtaaagtgaagttgatcctgcctgtcttacagataggctgtgaacattaatggtatgcattgaagactttaggacagtgtgcatggcacattgtaagcattaggtaaatgaaccgtatactacaatctttacaacttatacagaacgtagtatacttaaatgttttatatatttgttgttcattgtttcaacattctttgccacattcctgtgacactgggggatgcaacaggatcccatccagtgcagctgaagtgttgagaccgacactggtgacctccatctgctttctgctgcctttcagattgtcatattataatctttcgctttggtgaactagccttttccacttgctgttttccaccatttgtgaactggaaaaataaaatacacaagctgttcaaacattcttagtaagagtaaacagattcggagtgagactgtgaaggggcctgtttctcccctccccgccttttttttggttgttgttgtgagagagtaatggtatgggtgtttcacatccattttcactgttctcagctttacctctctacttcctggctgaggtactgagagtaagatatcactataccatagtggaaatagaaaataacctgctttgataatattgtgacatgtatttgtgatatgcttggcagtagcatcatgttagtgaaaattcctgtgttacagtgtggaatgttggctatcttacctgtagtacaataaacttcattcaaaatcctgtgcttagaatacagcatgatctttatggtataaagaggttttcttttctatttttttccagcacatttcaaggtcttactagttactagagtctaactcaaaagccttagtatttaccctttattttcttttttaaatccagtggtcagaattcccgataccaaaacaattatggatactattaaggtggctgtaatgcttatatacgcactgtgagttcattgagaattcatagttctgttaattctactcaattcttataataattgaaattcaccagcatattgttgtttatagtatgtggtgtaagtgaaattaatacttttcttttaaacattagtattttcagagaagaaccttttcctgttcttctgaattaatgaattgttacaaatttttgtaggtttcttataatgtggctacttaaatcaacatattaaggtaaactcttaagaaaagaaacataatataatgtactccccaaaataatgaatcccatgttttaggttggtatttagtctccacagctggaaaacactattttatgtgatgtataggaaaggctggaggcagacttggtgatttagaatgactcagtgattcatatcctgtctctactacttatgtatttagtatatatacaaatatatattaaagttagtatgtaacatcagaccaagtcatttaaccttttttagcttcatttttctcttgtatataatggaggaattcctgtagggttgtgaagactaaagttacttaattgtatatacacatagccttgtgccaggaatataattagaccatccctaaaaatgctgtttatcatgattttaccctttcaatgcatttattcaatatgatgcttgtgttgtagatgaaatatgtggatgttatgatttacaaacttgaaatttcattattttaaaatactctgtaaagtgatttatgtttgctcatatgcttttatctatgggatagacaatgcaatcctctctgtgtggagacagaggaaggcaacatttccatagtgtgttgttttatggttgactattactgcgagccactgtatcagaactgagatgagattagcactatttgagattttattttggagaaatggttttggctatggtcaagaatcttatttattagaaagaatgaattactgaataggctctcatctgtattctttctacttcagctatagcccatcttgccatcctgtaaaagaaatgctgacagtgacagaggagaaatataaaaatgtttccagttgctttcagtcaaatgtgattgaaattttataaaagatttacacattttttatttgtaatactgacagtactgggaaatgaatttctgtttactccagagaatagcagtcactttataggtgctttgaattttaaaacttagcaagcataacaataatgactggtgtattattaacatgcatgtaaaaggagtttaacatatctgaagagaaactggttaatgttattttacttcctatgtgtttttacagcctttcaagaatgaaacattggtagtaagtttgttttgaatgtttctctatttcatctttgtatgttggtttactacctattgtatgggattcaaagaatgtttatatcaaaaactgttttgtttagagcttatcattaaacctcattacttagatgttttaattacttttatatgtttctttctgtatttctaacacatacaatgagaatttactgttttccattgtgttttacatttttttcttctggtaagttactaagctaactcacatcagtatcttaattcctggagagagacccccatccatttatgtatatcctatagatctgattatggccttgttatggaaattggcctgactacaggcttctagtcattcatgccctagtattctcccctgttaggtaatttccaagatgcaccctctactatagtttctaagtaattcttctgagcaccagaccaagtattcatggaaggcctaaaatatatactttcaatggaaaggatggtagaaattcagccaattctgctttcttgggcttttagatattaaaaagagctatagaaatataattacactgatggatttcactgctctcaattgcctgaattatcagggttgagcaactgaagcgggtggaagggctgtttcccttatatctgaatataacataataaattgtccatcaatagggactatttgagtttgatattgatctttgatgttatgtatgctgcatttcattgattaaaagcatgcattctagttgggtctagatatacagtctaagtacatgatctatagttcagaatagagtatcatttatatagaaatttgcccatggccgtgttgtaattgtagcccattgattggcatctccaaggagcttgtgagaaatgcagaaattttttcctcacgcagatgcactgtatcagaattttcattttatcagttgatttttattaaagattgatagacattgatttgcattgtattcttaactaactgaaacaactggttccctgctacgaagcctaaatgtcaagcatatacacaacctgcttaattgtatagtaaggacccaatactataggatgaaggataggtacagttgagtttggccaaatgatgatcagagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggtcctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagtagaaagatgagcagaattttcagattgggtttggaaagagcacttaagaaagagggtggccaggtggtggctcacacctgtaatcccaggactttgtgaggccgaagtgggcagatcacttgagctcaggagtttgagaccagcctggtcaacatggcaaaaccccatctcaaaaaaaaacaaaaaaatacaaaaactagctggcgtgttggtgcccacctgcagtcctagctactcgggaggctgagttggtaggatcacttgagctagggaagttgaggctacagtgtgctgtgatcctgtcactgcactccagtctggatgacagagcaagaccttgtctcaaaaaataaataaataaaattaagaaagagggtatagtatgtacaatggccatgggcttatgaggaaaaatggcaagtttggagaatgccaaaggtatgagtggacgctaggggtatgggaaggtggcaatagggccttcatttacacagtttcatagactagaatgtgaatgttatccccagagttggaccaccaacaagcagtgactgtgattgttgcatcatggctttgtgcaaagtagcatctctagcgaatgggacaaattggggaatatgagggaattgggagatattctttatgctgtagaaagccactgcaagatttatatgacaaggtatacagtgctgatctgctgaccaatatattttctggcatcattccgtgtttctctcttgtgagtgaggtgcattcctttgctaataacatttgctgtcctcagacattattaaaggaaatttaatgctgtttgacaacatttcaagtagtagccattgatattgtcatggacatttattgttaatcacaggaacaagtttccttttctaacagcaaaatctcttccactgtttgcagtcttgtgtgatgatgaaacctcagcccaccctcctaataggcagtggaccatgaggcctctctgatgagccttcagccaggctcttctccttgctccagtacatcatgcaggcatgtgacctaagttgcaatgatcagaccctctcctcatacgtagaatcttgggcttagtaacataaggatgaagaaatggttagtagatgtatgctttttactgtgtcagtgtcctggccccactgaacatggtgtgtggtccaatattaatggtatctctactgggggttttggagctgctttgtcctctagttcttccttctattccatgcgctctccatatccttttgatagtctccttttcccaaagttggttattctttcttggaaccaaggaactataaagagaaatggaggttcttccaggtaaccctgtttatcctcttagctttctgttagggacatccacagcacgagacacacaagttagcttttcagggtgcctcttgaggcctgtccaggaatttggaaaattcatcctcttaaacagcccatggcattttccacagtttatggtaagtactcttatctcagtattctgcagaatgcagaaaggtaccttgtaaacttggggtataaatctctctattggttttcaagttgtggtgtatagctttattcaaagggaattctaacatttcatacaaccgcagctgccatgttatttcttttaaaagcttgtgccttctctgaataattcatattgtccagtgccttcagattgtttcataagatcaacacctaaaaagtcctttcttgttctagctaatacttaaagactcttttgcaaatgtgtttctagaaattgttatcacagttagggtgggcatttagctttttgtgcctagcctgtaaacttggtcttattaactttgggaaccatgagtcttggtatttatgcagtgagacttaaatctttctcgaaggtgctttatagtaacctgcatgtaaagcctctaacttgggcctggcactcatcattgggttggaccccaatcctgatgatcttcaaatcctctttcatacatagccatcaccactaaagtcttattcagctaatgttagaaacaaagcattgcaggaggcctcatatctagtaaatgcactttcatacccagtttactgttatcctccataattaacgtgaggcataacagaaaataatcatagaccaggcatacatctcaaagcttagacatgttatgaatgtcactccacataccagctccaatccatcattcctgtcctcagcttggaagtggaggaggggagacgtgtttatgggactaaatataaactctgtggggtaattgctacaaaatgtcatcctcagaaacacctgggagctttggaagaaaataaaatttcacagccccacgctaggtaataccgaatcagagtctctgggaatgagttttaggaaactgtagttgaataggctccccatgtgattctgatgttcagccaggtttgagcgctaaagcatgttctgtggaacactaattcttctaggtagatataaataggattccctttaaaagtgttcttaacaaaaacagaggaaattcaggattttaaacaggttttctaacacgagaatttttcagaatctttatgtgcattgtgaaatgcatgtttctgactatggaacaatcttgcttctctatcccccctgccaactccctacccaacacaaagactctttactaaacatctaatgttgcagatttcagccctggctcctccttagaataatccggttaatcgatcgatctggggttgggggtgggttctgtgtgggagaaacaaactcaaagtgtgttttctattctctcactcaaaaacaatcaatagagaagatttttgtgaccaaatttgtgggggaatcacccacacatcaagcaagcaatcagttttccagcagacactaactcagcgtcctctaattcagttcagtactgacactctctacttagagatagtctcagatcacagaggttgagggctcagtcccacaagactgtcccctactcccaatgccacaggcaagcctctggttgcctgttttaatggcatttctaaaacagaccagctataaattggtgttcccgcaacctcctccttgggttcagttaatttgctagagcttctcacagagctcagggaaacacgtttactggtttattataaaggatgttacaaaggatacagatgaagagattcagagggtgaggtattggggaaaggccccacactgggcctttcatgccctttctgggcacactaccctccaggaaccttttgtgttaagctgtctggaagtgcatctgaacgctgtccttctgcatttttctgggagcttcattaggtaggcatgattgatcaaagtattggccattggtgatcaacctcaccctcagtccctctttccttccaggaggttgggggagggggctgaaagtcccaaccctctaattatatcttggtctttatggtgaccagcccccatcctgaagctacccagtagctgccagccattcatccgctaattagcatacaaaagattttcctttggaggtcccaaggattttaggagttttatgtcaggaaatggggtgtaggacaaatacatatattttaccacttcatgggctaatggaatattttaaaatttcccgggtgattttattagacacgcagggtttaggaccacagatgcgatgtaatgttctttggaagacattctggatgatttatttatttaacaatgtgtcccacatcacccagattttttagtttcacatctgtcaggtggttttactcaacttacatatgtatcatcctatgtttagagcttgtttttaaatatctttttttctgattataataaaaactttttcttagaaaaaacaccccagctattacagacactcttagataaaaatgcattggttgtctaagtgaattttaatcataatgagtaatattaattgaacatttataatgtaccaaggaagtcactaaatgtttttattatattatctcatttaaacctataatagtcctgtgagctagatgctgtgatgacccctgggtcctaaatgagaaaactgagaatcagaaagagtaagtaatttgtctcaggtcatgcagctaataaatggcaatactgatatcatatcagatcccaggtatacctgattgtgagctaaagctcttaaccaatttggaatcctggttaagacagaggcttttatgtttagtgatcagtgtatgcttaaaaccccttagtatgtacatgttactttgtgaagcacattttattgcaaggaaggtgaatcttcataaatgacaggggtttaggaaagtattccaaatgttaagaaccattttaaaatgggaagattttcaaccaaatatttgcatatgaatgtaaacagaatttttgtagttatagtagattggtaatttgtgcatgtaagttatatattattcattaatctgaatgtatttgaatattccaaattcactgtttacatatatttttcctaccgataggcttccaaatgttgctaagcttccagaaatattgagtttgatagatttttttggttcctctggccagaaatttaaacaaaaagaaaagaatgatttggactactggcaataaaactcagtgaaggggatttatgtacgggtccgaatgcatgcttattagtcactcagaacatgatgtttcattttaaaagtacatgcctttgcatcttgttatgacatttagaaaaagttttcagttgcatgtctttcattttgccagagaagataaattgactaatatgtaaatgacattacagggtccaagtgtaatggttaattttatatgtcaaccaggctaggtctggatatttggtcaaacatgtctggatgatgctgtgaagatattttaaagatgagattaacatttaaatcagtggactttgaataaagcagatccataatgtggtgggccacattcagtcagcagagggccttcagaaaaaaactgatctcccaggagaaagaattctgctagcagacagcttttggtctctggctgtgacattaactcttcattgcttgtccagtctgttaacctgccctgcagattttgcacttgccaacctccataatcacgtaagccaattccttggtgtgtctctttctttctgtctctctctccgtgtatacatctagtccatcctattggttttgtttctgtggagaaccctgactactacaccaatattccttattctccctgtatgagaaagtttctctagctgtttttagaataattttatttggatgtccttacccgcaaaatcaactgttagacttttgcagaatgattagtgatggatcataccaaatactgccatctccaacactattgatgtttccccaggcattgggcaatttcatagatgccatatagagtaaatgggaacacagaaagttcaaagatggaatttgttactccctggaaatttgtagtggtaaaggtttccaggtgtggcttttgtcttccagtccaagtaggataatttagagaaatgggaaaataatctctttctagaatccacttcatttttccatttaacctacaggtatcaagtgctactaagccgtaggaccaagctagatcctatgggtagaaaagaaaagaagtggatatggaacttgccatcatagagcttagggtgtggtaggggttacccaaaaagagttaaacaattaatactttaaaaaattataaactgtataggggctctgaaggagaaaaggaaagtgctgagatagtgcataatgtgggcaggatctagtgtaggtggcagagtcaagaaaggcttcttggtaaatgtgaattttgagacccccaaacttgagatggagctagccatgcaataaccagggaagaaagttccaggcaacgaagacagcatgtaaggggcagtaggtaagtaagagcttgactcataacctgatttaagttttaatgtacaaacaatcaagttgtcatgggtcaagaaagccttagactaagctgagtgaagggggctctaaatagaatcatataggagaaataacactgggaaaatgaggatagtttagctggattctactttgagagtatgataaaggagaaacattagtttcacactttactagtttttaaatatgtgtaacttccatattatttaaactataacatgaggcatttaggttatatatatatatatatatataaatatatatatatatatatatatatatatatatttttttttttttttttatgcagagtctcactctgtcgccgaggctggaatgcagtggcatggtctccacggactgcgagctcgcttcctgggatcaagcaattctcctgtctcagcctcccgagtagctgggattacaggtgcacaccactatgcccagctaatttttgtatttttagtagagaggagggttctccatgttgatgaggctggtcttgaactcctgaccttaggtgatctgcctgtgtcggcctcccaaagtgctgggattacaggcatgagctactgcgcctggctgataaataattttttaagtatgcatgtgactctcacgagtgtggactgctagctaaggctggctcatcaatatttgtctagagatcttaaaactgagtgaaatactgtctaagtgaattttaatcataatgagtaatattaattgaacatttacagtgtaccaaggaagtcactaaatgtttctattatctcaattaaacctataataatcctatgaactagatactatgatggcctctgggtcctagatgagaaaactgagaatcagagagagttagtatgaggctcctcacactttgggaggctttctctgcatctgaagccacttgaaagtctagactcattgactttgtgaattttaatgacttccttcctccctcccttccttccctcccttcttccttccttctctccctccctctcttctttccttcttttttccccttcctctctttgttccttcctccctcttaccaaatgctagtacagcactggatatggtgaatatatcatttcaggcataagaaattatatgccgtgtaatcccagcactctgggaggccgaggcgggcagatcacgaggtcagaagtttgagaccagcctgaccaacatagtgaaaccccgtctctactaaaaatagaaaaattagcccgatgtggtggcacgtgcctgtaaacccagctactcaggaggccgaggcaggagaatcgcttgaacctgggaggtggaggttgcagtgagccgagatcacaccactgcacccagcctgggtgacagagtgagactccgtctcaaaaaaaaaaaaaaaaaatgaagttgtgtgcacggggacccatatcctccagtcctatagaattgtaagttggttactatagaacttgtgctgtatttggaacctttcactgaagaatataagcaaatgtcaaacctgtaatttgtcagagtttccatttcacaatctgaagaactgaagtgtacaaccttcactctgcattgttgaaatgaagagaaagagttaaaggtaattatccatataatttgaaagaaaaaatgtctccttctgctcaagaagtagggtctgataccttgattaatttgtactggttactaatatttaatttccctggatagtgtctgaactttccatttcagtttgccattgtaccccctttgtattttaaaattatttttctttatcacacctgtaatcccagcactttgggaggccgaggtgggcggatcacgaggtcaggagatcgagaccacggtgaaaccccgtctctactaaaaaaatacaaaaaaattagccgggcgtggtggcggcgcctgtagtcccagctactcgggaggctgaggcaggagaatggcgggaacccgggaggcggagcttgcagtgagctgagattgcgccactgcactccagcctgggcgacagagcgacactccatctcaaaaaaaaaaaaaaattatttttctttaaaggttatttgtctatgattgtgcattttaatagtatgaaagggtacctggtcaaaactgtttgccttttgtcactttctgctaactcttttccctagagacaatgttactattatttgtttatcatttcagagatctttattgttatatgggcacatataactgattttgtcagttaaaaaaatctgaatgcttactataaaaaatgatggcatggaatatttttcttcacttaaagatgaatcttagatgtcagtctacattaatctatatgtagctaactcttccctgcgaagagtatttattcctttgtacaaaggccataatactagaacttgctcataagaatttatgttctttacagactcttgctatgataaacaatatctttgtaaacatgtgtgattatatctgtaggataaattcctgaaagaagaattggaatttttttggtcaaaaatactgtattgtacatttaaaaacttttataattatttccagattgccctgcaaagaaattatcataatttacattctcaaaacaaggttgtcataatgtttgagttgatgcagtagctccttagcaattaatagacgttcattttacaatctgtcaacatttgcaactttcacgaagcctcacaagtgatcgtgtacccaggtaaaacagcttatgttagacattcttgtgcaaggtttatggttggctgttgttcttaatcctttccagttataagagctcattgaatgtctcagttcaaggttgccatgttatattatgagacattgggtactgtcggtgagacttggcatgactggacgagccattctgatctttgaattacacagcaagtagaagccaggacagtatgttcttgacttaaggcatcctcagcaaagtgataacctagctgatcttctgagaaccctcagccagacacagtggagtttatggtaaattatagctcttgttgagcattgactatatgcctagcacccttgcatatgatttctaatctttacaacaaccctccaaaatgggaataactatcctcactttacaattttggaaatttaagttcaaaacggctgagtgcatttctcaaggtcaaggtcacataactaataattggcagagctatctccctctgcctgcttccagaggagtttttccttttattgcatcattgcaattgaccatcagaatcacttggctttactaattttttatgcattaaacaggtttttctggtcagtatccaggcaaatttaggcagttcttgtttggaagggtcctttcctttggttggtccagcttttgcacccctgtacttagagggatgctcagatgctcagatgtctttgctactgctgtgtccagctgtggtgtatcttcccatgctgaccctactctcatgtttctgaactgacatctcgcaagattaattgagatgctgtagttttctagcgctacactggctgtaattagtcgctgacatatgatgatttattataggggattcctttagaaatttactttgtgttttgggactaagaaatgatcgttagagtttcagacttacagctcttgtcctgcaccacttaactgatcaaaactatgtttgggatgaccaggcagcttgacatcatagcactggtcatcctgactctctaagtaaaactgaaatgtgtggcaaattaaaagcagtgaagatggtgcatggctaaattaattcatcttgattaggccctggtgaatttttaaatatataatcagatgtgagaatttaagatgtgggatagtcaaagccaagaatccaggaagacttctagcaattccacaaagacaaaaagcaaagatgccagaagactgtggccaggcttgcttgtggaatgaaaataaggggaaaaaaatcacttacaatagattaacagtataccctgtcaaagagtgtgccagaagtcacgtaaaattcccaacccactgacagagattttggagaggtgatgagagtgaggggaagggattatctgaaaaatatgaacaaggcagtagtgaggaataagatgccagcatcaacttccgctgtcacttgttttctcaacggttagccatgccactaaggtcaactcagtatgttattaaaatgggcggttttaggtaatgattactttcttggcagatagaggattcttttatctttggggtcatgcatttttaaaagcctttgtctgcatagatttatttaaaacacacacacacacacacacacacacacacacacacacacccccttaagcaaggtatgctggctcacacctataatcccacactttgggaggctgaggcgggaggaccacttgagcccaggagttcaagaccagctggagcaacaaagtgagctccttgtctcaacaacaacaatgacaacaacaacaacaacatctgggcatggtggtgcatgactgtgatcccagctacatgggaggctgaggcaggaggttcccttgtgccaggaggttgaggctgcagtaagctatgttcatgctactctactccagcctggaagagagagtgaaaaacaaccaaccaaccaacaaaaaagcagcttgattgaagtgtagttgatgtacaaaaatctacacagatttaatgtatacaatttgcggattttaatatatgcaaagatgcatgagacaatcagtacaattaaggtaataaatatatctattatctccagaagtttcttcctgcccccgctccatgtttttactggtaagatcacttgacatctacttgcttgacagatttttaagtgcataaaacagtgttgttaactataggcactatgtcgtgtagcagatctctagcacttattcatcttgcagaattgaaattttataccctttgtacccttgaacaataactctccatttttccttcctctacaggctctggaagccaccattctactctttgtttctatgagtttgactattttagataccttatataagtagaatcacccagtatttaaccttctgtaactgccttatttcacttagcatactgtcttccaggtacatgtatgttgtcacatatggcaggatttccttctttttcaaggctgagtaacattctattctctgtgtgtgtgtgtgtgtgtgtgtgtgtgtgtgtgtataacatgccacgttttctttattcatttattgatagatatttaggttgtttccatatcttgactaccgtgaattaagtaaactccaatgatcatgggagtgcagatatcacttctagatctaaatctttgacatcttgacttcaattcctttgggcacagatttctatgaagatttcttttttctttttctttttctttttttttttttttgagacgagtctcacactggcacccaggctggagttcagtggcaccatcttggatcactgcaagctctgcctcctgggttcaccctttctactgcctcagcctcctgagtagctgggactacaggcgcctgccaccatgcccggcaaattttctgtatttttagtagagacgggttttaccgtgttaagcaggatggtctcgatctcctgacctcgtgatccgcccgcctcagcctcccaaagtgctgggattacaggcgtgagccacagcaccaggccttctatgaagatttataagttgctcagtttttatttctggtgtgtgtgtgtgtgtgtgtgtgtgtgtgtgtgtatgtgtgtatgtgtgtgtgttttaattttaaaaaccctgtcatatttaggatatacctcgtgatgagtgtgatcagcactaattgtcactctgttatactaaaagctctttccgtagtgtgtcttcattgcaagcatccattgtgtatggaatcctgaatacagttatttgaatgtctgagtattaaacaattaactgtctttacagaatgtcctccggggaacatagtttttccttagggacccttgggatctctaaccgcttaaaatctagaagctcttatgtgataggatgggaaattaaaaaataaatctctactatatgttaggatgtccatactgcatatagctccttaagataatggactatgattctatcttgtctctgcgcccagtacatggcacatttcagggtgtcacagatttcctaggattaaaatgcttagtaaatatatgaatgaattctaattttagtttctttatctggcaccttttcttgtactttctgagcaataagaagtaggtatctgggtttctagtagatttatgccatataattaagaaatattgatttaataatttttgtgtcctgtgaactttatttaatcattagctaataagatttattgagcatcttgcagttctgtagccctgtgcttgatggtgttagctccttagcacgtaattgttttgactagaatggtaatttaaggtaatttgatatacaaaatggagtgctatgtatggcaaagttgagagggggtgaggagaatataacttcaaacctgtttgaaaactcatcaagtaatatttttcttactttaaatgtgctttggcctcctttgtgtgcaagcaatagagacctatttaggctcctttaactactgggggtttatcaaaaggtgaaatatagaaataaagagacgagaaatactgtccacatgggagattctgatgtgaattctgggaaagctgcacaagtgtggcacacctggacctcacctagatggagggtggttcgaaactagaaggtcctttgtgacttttgtctgatgaggagtcctagcagtttgaggatccagttttcatagttacatagttaatttagtttaatgacttattctgtctttttcatctttgtggtttgcgtttttctcctttctcaatgaattgctagctctcttctcaagagaagcctggattgcttaagttaccatcttcccacctttgtgggcagtgcccttgctggagtccacctgataccctgtggatcagctgccctttgtcgggttcccatcacagccccaatgtgctgtgggtgaaggggtggccagggtgttgagagagagccaagtccatcagagaactttcagaagtaccttgctgtgaatcatccttcacagcctagtgggtgccgctcctcccttttattcaattttttaataaactcaatatttgatcaaattaagtggagggagggaggatggaataacatgctcctgatataatggaaaattcaggctcattgaacttgtgtgatgtgccacaatccttttagaacaagaccgtgattgaaactagtctcttttctctattacttttttgattgttttaaaaaaaatcaagaatatttctaaaatataaaaaaaattacaggagagataatttgagtatcttcactttttacactcctgccaagaatgccccacaaccccacccattacagaaggatcagattccatattggaaatatatgccaatttcaatttagctgctcagtaccaagaattcttgcacctatgagatgctaaaggtttgaactaaatggagccacattcatcattgttgtagaaatctgccagtgtttaaaaggtgctacagggaacctttaagtcatgcaccaaattaaaagattgcaagctccactggtgtagtcaaaagcaagctcaaagctgagtggcatcaaaccaagagtagaagataacttgttactgaattttgttcttcctctgaatgccactctttcaagcagagcgaggaaaatatgaattttgtgttgttaaaagatgtttatttccacaccctaatttatgtttcaaactgcaggcttttgcagagagtgtttctctgaaacttttaaagaaagtgacatgttactacatgggaagaaaagatagagcctggttggtaatgattatacagtcagggctttatctgcttgcagataatttgtggcttatttttaaccgtctgccagtttcttttctcattgttacatttacctgctgattgcaaccctgagccaatcagtcactggtgagcatttggtgaattctacttttttaaactggccaaaagaaaacacatatttccagaatggacacagtgatactagctaatatttattgaatacttattatgcagtagattcaatattttaaatttaacatttacagaaacctcaccatagcaagaattatcattactgttttactgatgaatagggtgaggcttagaaaggtaagtaacttgtcaaggtcttaaaggtagtcaatgtcagaggcagggcttggatccaggggaaacctggtcaattttaatcctgcactgagaggtgatcacaatctgaagactgtgatcgacactaagacagattttgtcaaacaagctggtatcatgaggaagtcagtttggatgatgatggtatcccataacatgtctcaagaagaacttaggatgtttagcttatggtggtgtaaattcagtgcaaggggatgtaataggtgtcttcatttacatgaaacaatttcaagcgaaagatgacttagatctgctttgcatttgcacaggggtgagatgtaagacatattaaagaaaaccataaagagccaactgaatgaaatgattcatcaataaatgtgtttcctcaacgtatagtgagtgtcctatcaatggaaactttaacaaaggagctagattttggttttacaggactcttagatctatggattaagatgtgtctgtaatattagatgtatcttagagaataattatccaaaatatacttcatggaacatggaggaactacagactaacattttctatggtaaaatatttgggaaatgcttcattttttctttcataatatattaacacgttaaaggccaaatcaactatttaggaaaagaaaataaaacaaaatttcaccaactttatgaagctaacatttcctgagctttaacatttttcatttgttattattttttgatactaggaaagccttcttgtgatactattaagatcccatagaacattgcaaatgcttgtccaaacctgcaaaaaaaaaaaaaaaaaaaagcgcacatcatgtgcagagacttcccatgggcattgggtgcagctatttgtaatgagaaacaaaataactgttggcttccgtagtggacttgtgagaaccagtagttttgcatggtgcagggatagataagaaagttgttttcgatatgctattttggattctctcactctaggaaataatcaagtgttgatggtattaaatttcctttagcatacatgcaaagagggcatgtttatagactttgacttgaacttcttctaacaggccttattttccctgagtatgtttctacttacttaaaaacagatgctctctgaaaaattcatgaaaaccaaaaatatgctggagactttggagagaagctcttcaccctgttattaaagttagattgtttctaacaatttttttttgcatcttctgcttggcagttaacttcatgaccttgaacaacctttctggctttcctgtaactcagtttccttcatttacctacctacttaaccagattgtacataaaaatacatagtatatatataaatggttatattaacagatagatcctttcaaacacacttatattggtggctttgttaatgaatattgcatttgtggcagatagacatgtttccttaaatgaaggttttcaaaactggcattgtaagtaaattttacatattatcagttgcttgcacccaaaactatttctactgtgaactggaatacatcttaagaaattattttaaaagatgtaaataactagtggtaaagtgatagagcacatcataactttcttcattatcataagtaatgtggctttgtccatatgttattctcatttgaattataattcttatttttattgtatgggggtttgcacacttttgtcctcaacttttcttgtttattttaaaaagggagtctcaggatttttcttctgaagttaaaatttaaccctaaagaaagatgccacagtagtttagtctgcttttctggagctctgaaccattgagggccagaactgacactataagcaggagcagcagtcccaagatgggattctaatatcaacctttgttttatctgattcactatgagtaagaggatacaatatgagtgaacagcaaacctgtgagaaacctacaagtataaaaccaatggtatttaattcaggtaataaaatagaattcttaaacaccctctaaattaaaaagccagaagatgcagttctaattacatgccttaactagaagtaggatatttgcagcttatcaagttttatgtaaatttgttcctttggcacaatttgcctatataagcagtattagttcagtataaaatgtttattagttattgaaactggctctagtgtaatttctgtgttttaatacatagtcccaagttttgtgggatccctagagagaactgtgtggtgtctatgttttgaataaacaggttttttgaataatagtaacttacatatctatagtctcttatctgaagcccttggggtcaaaagtagtttagaattttagattttagaacggtagtatgctactagtgctgtgtgctatgtgacattccaatagaatcttgggcaatggccaagcatgttgacatttcttagtgcttgaatgggataaagatcataaagagcatctttttcagctgaggtcaggttgggctgacagtgtgtttggttttccagagcgttttgcatattggaactgcagataagggattatggacctgtaatattaaatataatagctgacatgtattgtgtttattccaagccagacatggtactttacttgtattatctcatttaatctttgcaactctttgaagaaggtgatagtattaattttgttttacagatgaggaagagtttcagagaagttaagaaacttgcctaaggatacatacacctagtaagaaagtggtagagttacatctcaactaagtcgaattagacaccaaatctggtgtgcacaataactagttatcctcctcgtattcagtgtctctgatttgcagcccatagactcagtcttacatcaacataaagggaattaatacgaagggtatcaggtgatggagtatcaggcccaggggataattgggggaaagaatgagtctcagtagcaacacttctttgatagtctttcttggccatttccattagaataaatatacttctagtagcagtaagattcagatgagagagaatacttgagcttgtgttgctgttagctagggtaaagtggggtgtcacaaatccagcatgatggagcagtgttcctaaaggaaaattgattgctgtcagcaaaagatgtgattcacgtgagacagcacactcatgtaaaatgtccactgtatggatgattaattaattgcagatgaaactaacatttggatgaaaaccccagttagttttttaagtataatccattttaagtttaccacctgcttgataccagcaaaacagttaacttatcatcttgaatactcagattcctgtggcagttcagacactttctaggtcttggatctcagatctagaatcagtgagcttttttcttatttgtaatctgagagcaacagtacatctcccaatttacctagtgggcattgtgttagctaagatagcccaaagagcttctggaagttcataccctatgtgttcatatttctcatgctgattctgtgttgttcttgtataaccagcagatgcagtaggggagatcctgcataacttctgtggccaagtcataaggagccttgcagtgtccaccttattttcttggcatcttcactctaggggaagctactgccatgtaagaagtctgatcattatgctgtgaggaagtccaagctaaccacgtggagaaagatcaattcctggccagccagctgctattctagctctcccagctagtgtgccagacatgtaaattaccttggacatccccacccaaccgaaccattagttcatttcagtctaaagtgccatctgactgaaatggcatgaacgataccaagggacaactgcccagctgagcccagaccactcacagaaacacgaggggcaataatccacggtaataagtcactaggtttccccgtagtttgttatccaatagcagatatccagaaacaggtttgctgtgaagaagagagataatgtgttatattcctcaaatgaaggtgagcagctgttttattataattgctttgacaatccagaaagcaaggtctttctaatatcctcagaggtttcattacaatttgccattgtgatgaggatagtgatcatgctgtactctctggacagggatggagagtgttagtgattggccagcatccaagattgtcatcatttttccttagtgcaggagtttaaaacattctgccattttctcactcgtatttatattttcacaatgaatggggttttctctaataagattactgtcataaagtctcttatttaaaacttctgatggatcctcattgtggatgacagggcccatttctctgtttttgtagactgtccctctgtccagaaactacaggggaaataagatgtagattttgaaaaagtgacagcgagtcaaagaacagttggtcaaacagcttcccagcagttgggacaggctgccagagtgaatgtcaaagagaagttggttcttggatggttttacagaaaaacaagacaatgaaacaaagaaataagaaataagtaggaggcatgcagagggacaaaaatgaaggacttgatattaggacaccagagcaatcagtagtaggttggataggaggagttgagaagagggaggaggaagcaactaagggttggttggaacttcaacacttaatgggttcactccctcctgtctgtaattaattctagctttagttacttcattttctccttagaggaagataaagtgacctggactatcttctttatgttatagttgtttagaatcaaagggcattttcttaaagtctcttttcccaagtaattcttaagatttcttaagtgtcattgtctcttcaggtggagtcataaaatgcatctctatgaggggcaataaaatgcatggaggtgccttttatggctgttgctagcagaggactagaataagataatgatggtattttgcaaatagtgataaggagcaaattgcacattccaatgtcaatctgttctcaaaagagtatagttcaaagtttctacaaagctttttgaaagcttttcttttttgaaatgagtctctgatttctgtttttcctagctatacatagattttattttggggaaaattttaggtagtaacattatccttaatatttactgatttgctgtagaattttaaactggacaaatgaaagcccttgaggaagagaaatttatattctaacatagcgaaataaatatatgtcttgcaacttgaattgttgttaggaaattacttgtatgcctgagttcatgaattatttaatttaagattattttcctttttctaatttatcactggctaggtcctttaacaatcttttgatttattaagagtcattttccagaattagatttaaagctctattgttttcttatgattttcctatgaaaattgagtatgtctcctataaaagctatatttctcttgtttgacttatttcatttctctattatgaaaggcaatcattttaaaactgatgaaattttaaaaaattgacctaatctgaaaaaaccagcccatttcatgatccttcttcacttattggaaaagactatggagtcaggagttggggaatgtaccgacctccattaagaggtaaatgacttgcttgtgtctagaagcgtttgtgtcatttgcctctcagtgcttgctgcagttttaaggaaattgtcctcctattaaggttatgtatcagaatcacccttgaaactttttattaataaagattctctgtccccacaatgaggtttattaaatcagaatctccagggcactggtgtgctgaacgagtctcctaggtgatttgaattcgtaccccagtctgcatctgaaaactgccgcttttcaaagagaggcagacaggttgatggatgataggatccagtctgacacatggaaaagctacaaggagggagcatggaggaatccttcatttagggagacatgagtattgtgaatgatggtgtaatcactgctaaaaatttctcgggtttctaagaaagttttatgtcctcagttttcttgatggtgtctccagccaagctgtaatgcagtggttcccaactaggggcatcttggtctccaggggctatttgacaatggctggtcctatttttggttgtgataactaaggggatgccgctggcatctagtgattagaggccagggatgctgctgaacaccctcagtgcaaggggagccctgtgttagtcagaattctccagagaaacagaacatatatgatggcccagcttatgcggcagtcatgtgggagttttctcttactcagctttttgtcctcttttgatctccaattgattgggtgaggacctcccacattatggagggcaatctgctttacttagtctggagattcaaatgttaacctcatccaaaatatcctcacagacacacccagaagtacatttgaccaaatgtctacacaacctgtggcccagtcaagttgatatataaaattgaccatcacagccccttacaacaaagagttatcaggcccaaaatgtcagtagtatcaaggctgggaaaccctgatctagtgaagtgcagtgaaattctcaaaataaaaatattctaggggccagcattgaaaaggatgtggcagggccaggtaggagagcattagagatggcctgtgtggaccttgaggaagccagatgagataaagaggaggagagggcatgaacataggataaaagctcgagacaggaagagatggggttaaaatgaacatcaggtacttgaaaagagggatgttcatcaggtgttatttttcctagcagtgttatgtaaaatacgagtactatctgaaagtctgaaaaaggtagggccaatttaacatcagctttaagatagtaaatctctattctgtaagatgtaatggtagtttttaagccttgaaaattggaaatgttagacaatggtagcatatgtgagccagagagaatttgatggtaaatttgtagtacagaactttagacttgtttttaccaggaagaagcatcagagaaacagtgagagtaatcagcgcatatttgttgtatttccgaggctggtaatggagctaaagtgtgggggcagagctttttgtttgggaaagtgtggaaatggggctggtcaatgcagatgaaggggtgctatgggaaccttatgatgtaaaatacactctctcattgtcttcacaagtgtagctctaattgcctgacctatgtgcagatttgttgttcagaacaaatggggttaccataagtatggaaaatggttcctggtctacagcgaattggagagactagagaggcaagccagtgctcttaaatagcagtgacccatctaagttcatttttcatcacccttctggtaaatacttcctaattttctctaggggatgtgctttccccatgtttgatctgtttttttctgagaggtgtttggttcatcctggttgtagggttgggtttgtgatataggcatagcctctcagaggcatttggccataagtcttatctgggtatgggctcatgaccccaggtcaatctagtcagatctgctgatgttaattctgaggctcttttctttccttacttttgtatttggaggtgtaaggatgtaatcccacgttcttggtcataatcttgtcatactatagaaagggactttttcaaaatgtagttaattcaaggaagaccagagttgagagaccttatatcatttgtgctcctggatgaagctgtacctgaagctaggttgtcccagaattctgttagtaaactattaaatttcttttttggttatactagtttgtgttgtttctttcactaatgactgaacaaattactaaaagatacactgaattattaggagaaactgtccaattagtaagtgatatagccaactaataactaattaattaatgtttcatactccagtatttgggctctgtgtatatattggtgatattcttccattcttgtttgtttgtgttttggagagtttgacaaaaatgcataggctatctctggtaatgcttggtttaaagcatatttcatattcagaaagatgttgtatttgagaagcgacgtggtaattggttttgagagtatacatcttagacaattaaatggttacattgcttccttccttggtttaaaaaaaaaaaaagaaatccaagggtattccagttgtataaatagggacaacacagtttatgctatttgtaattacagataccactcaaaagaattgattccgtttacttttgtattagtgtactgtggaaagtcgttaattataatgtctgttcttatccaacaacatgcaataagtaaagatgaaaatatagagattattagtttgaataactggttgcatgccatccggttttatatgattgctgaaatgcaaaacaaacaacccctccccccgaagaaaacaacccaccgttcttaaataagacatttgtgacataacaaattagaatctaggagaaggaaaatattttcccagtatctaaagccattgaatcaaaataatcgtgtagatcacactttagttcagatataacctaaataaattctctagccagggcacccatctgtcaaaaaataaaactctggccctcatttaaaatggctcctttagactgaggtcatctagctgtatctaaattggacatgaaatgtcaatttcataccttatagtggcacatttcatattgctctacttaaggttatgtcagctttacccataaaatgcaagtgatttaggtcttattctaaatgaactaaccagatacatcagcaatgggcactgccttgccactgcagaaaaagggaatgtgtgaagggaagacagaaaccacttattctgtttcttaactctggaagtataggtattccaggttgggatgtcttgtctatattttcattccttgtgaatgataatttgggggtggggggattagaaagatgctttattcaaaatgaattgtattgcctgcaggcgattcacttgcttaagttatatttgtgagttattgtatgtaactttatcacattggaaagtttatgaaccttgtgtagaaaaaagattgcattttgggagctatgcacatcatggctttttcacaagtgacagaaaagtgctgcagatgatttaagcaggaagaaatgaatttttcgaaagattttgagtccagaagggagatagggcagtcagtcttggaagatgaaaaggacaaagccaaagcgggccaggcaggcaagggagtagtgttgtgaacgccctaccccacccctactgcatctgagtgttgcaactgcctgtgttgccactatgtaaacactgctccttaatatctgcttccttggatccgaattcagagccctggggacagtgcatctcattggctgagcatgtatcagccattggtaaccaagctgcaaagaggctgggaaagtaagtagtcggctctttcagcttctagctggaatgtgatcacctcccaatattcttcttcttctttttttttttttttttcgagacggagtctcgctctgttgctcaggctgaagtgcagtggcacgatctcagctcactgcaacctccacttcccgggttcaagtgattctcctgcctcagctccctagttactgggactacaggcgcccgccatcacgcctggctaatttttgtgtttttttactagggacggggtttcaccatgttggccaggctggtcttgaactcctgacctcaagtgatccacctgccttggcctcccaaagtgccgggattacaggtgtgagctaccgtgcccagccccagtatgtcttcttatagtggggggtatctaaaaacaggaagaagtttcagatgcttggcagctgacatggctaattttaggtcaacttgactgtatcatggggtgcctggataaaacattgtttctgggtgtttctgtgaaggtgtgttaggttgagatcaccactagaataaatggacttagtaaagcagattgtgagtggtcatcatccaattcactgagggcatgaatagaacaaaaataccgaaggggaaaaattaagaatttgtccctttctcttcctgcctgctggttgagctgggacattggtcctctcctgccctggaactggtatttataccatttcctggttatcaggccttcagacttgaactggaattacaccattagctcttctctggatctccagcttatagatggcagattttggaacttctcagtctccataatcatatgagccaattctttgtaataaattttcttctctctctctctctctgcctatctatccatctagttatctggatatatcgcctatgggttttctttctctggagagctctgactaatagagtagccaaagcaaagacagtttgtatgtgtatggttttatggggagtggattttcaggaaagcaggaaaaagattttttccagggcacttgggtagtgcatcttttttcctctaacaaatgggggagcatgtggccttctgagtactgggtttgcttaatgaatcaggagagccagtgtttataaatattcctttaaatggcagagcgtagatcctggtttgtagtccccttagtatatttgtaatgttttcatcatacccctaggccaaagaaaatactcaacattaagtagttttattcattaggtaggtaggttgaaacaaatgaataagaatttatgtactaacgtaatttgaaaaacatatatatcatttgaaaaaacacacaaattgaaataaaatatttttttcttaaataaccactattgcttactaatgggatatatcctcctgttgggcacagaatgacttcacatacattggaattagattggacactgctacctgattcccatccacattgattttcatgacgcacattttattacagcaatggctatgaacccagctttgcaaagatataacataatgaaaaggaatgtaatgcaatcaaatattgaaactgccaactacctcgagctatcctgacagttgagcatagcttgggagtggtagacatagattatcactgaaattctaatgtgagcctgatggcaacttgagttgaagggcattcttgcaagactgcttggttggggagtgtcacaccagctggatgtttccagaaccaagggcctgggaaaaactatgccagtgtgcacagtgcacactcttcctcagtgtagccactctgcttctgatgtgttttgttgtctaaatcagtcagcaacctatcacagatgtgtgcatcttttcctaccaatccacaaaacccacctgatacggtttgtctgtgtacccacccaaatttaatcttgaattgtaatccctataattcccacctgtcatggggggcacccagtgggaggtgattgaatcatggacacaggtctttactgtgccgttcttgtcatagcaaatgcgtctcacaggatctgatggctttataaagaggagttcccctgcacaagccctcttgcctgccgccatgtaagatgtgcctttgcttctcctttgccttccaccatgcttgtgaggactccccagccatgtggaactgagagtccattaaacctctttttctttataaattacccagcctcaggtatgtctttattagcagtgtgagaacagactaatacaccacctgaaataatgtaccccttaaaatccttatttatggattgatgagaaaacagagctttcattttatatgattaacagaagataagtgcctctgttgcccagatcagactgtcttagttcattcaggctgctataacaagttaccattttctgggtagctcctaaacaacagaaatttatttcttacaattctagggtcttggaagtccaagatcacggcaacctcagacacttttggtgagggcccacttcctggttcatagatgggccttcttgctatgttctcacatgggtataggaggtaacagagctctctgcagcctcttttataagggcgctaaccccattcatgtcctaattacctcccccaaagccccaactcctaatagcatcaccttgggtattaggatttcaagatatgaattttgggggaacataaacattcagaccatagcataggccaattaagaactaggtatatgtaaaagcatggctccttttttggtacaaagctggtgtatgcctcaaaatttatattttgcactcagaaaaattcttccttttattccctgaactgcttgttcatgtgatctctacttctgtatgtccaggtctttgatatgtgtatgagttgactgtttcattgtgtcggaacatcttttgattgtgtcaagagttccagcttcttttctttaaagatcctgttttataatctgccagcctgaccacactcagcatacagtcttcaaagttacaggttatgtgaaactttcaaatgagatattacttactcctgttcttcagctggaatatcagttgctgggggagctggagaaacaattcccaaaatgaagagcaccttagcatttctacaatgttgtcattgcagggtattgtgataggcagaatgctggccctgccccaaagatgccagtgtcctaatctctagaacctctgaatatgctacctcacatggcaaaagggactctgccaatatgatgaaggtaaggatcttaaaatgaggaaaaaattctggattatcctagtggacctaatattttataagtgtacttgtaaatgaaagagaggggcaggagttgtgattatgtgattgctggctttgaagatgaaagaggaccataagccaaggatcaaggtcagtccctagaaactggaaaagccaagaaaacagactctctgatagaccctccaaaaggaacaggaaggaagccctgcccagtcttaattgtagcccagtgagacccattttagacttctgatttccagaactgtaagatagtaaatgtatattgctttaaattactacatttgtggcaatttgtcacatcagtagtaggaaatgaatacagctataaagtggaagaaaccatagaaagttcactgagccttttgagattaatctttaactcatattctaaaatcatatagctccctgagtgtcaaactgataactacataatcacactttcactgttctcaggtttactacaagcagaattaccccatactggtgttcaggcagatgaattctcactatgaaatactttttaattggcgttcttatgattgcctccaaaatgtttaaaccttttgacagttgcatccattttatgaatccatcttcagtaataaagattgaaatgctctaaaccaccaaaaattagtggcttaatcagaaactgagggtggttctataaatccaaagctgctggtcattagacctcactaccatcattatgtatttcttcatcctgatgcatctcacattcattttttgacacgttaatgatttctgtcgtaggcatattaactgtccacatgtaaatgtgatggacactgctttggtttagcatggggctatttcgattggtcatacagccaaagaaggaagtaaaggatgtaaacagtgtgggtgcttatatttttttccaatatttgtggaagcatctgtttctacatatgactggcacaaatgatatctttttgtaaaatatttcataatttctccaaaatataccagctttctggttttgtttttagagctagagactttgtctgctctcctgactttttgatattctttctttcctttttttttctttcttttttttttaaagatggcatctcattctgtcgcccaggctggagtgcaatggcatgatctcagctcactgcaacctcacctcccaggttcaagagattctcctgcctcagcctccccaatagctgggattacaggtgcccgccatcatgcctggctaattttgtatttttagtagagatgggctggtctcgacgtcctgactgcaagtgatctgcccgcctcggcctcccaaactgctgggattagaggcgcaagccactgtgcctggctgatatgctttcatttttcactccctttttaatcttcccctccattaccagttaacaaactactacagctgcctctgcaaatgatagaagaacaaaaattaggaggagagggggctggaggaggagaagaaagaagcagagaaggagaaggacttcatagaaactacggctgctttcaggcatataatgtgagatcttgagagagaattaaggagtgaatttccacgtaactttcaaagattgtaaataggctgcctctattttttgcaattgccaggcaatgacagtgtactttacttctactctcctctgaaggagcaaaatgagtgctctatggccttaacctctatttctctcttaactggattcaaacgtatgtcatgctttgagccttcattacgtaagcgatttttctcaaggtcactgggagcaccacgttcactgcctctggatggttcactgtactgccgtgcagccttgctgaccatttcatgatttggggttcatgttcattttatagactggatttttttctgttttacgtttcccattttctttgttacttagaattaaccatgaccagatcaattaataaaatagttcaggttgtcttattctatttgtgcatttggtttgcagttaccttcacaaatattctggtggctaatgaagttaaaccaaagtttgtcaatctgattttacataagctgtgtgccaaaactgtgttaggttcaataatgctcattttcttgtttaattttcacaacaactaagaatattatcagattcatattctccttagataattaataattaatcacattattattctcctgagaaggaggtgatactattctcgatttagacataaagaatcttaggctcagagaatcaccagcagattgtaattttgagcctagatcatcaatgtctaaattcttgctcctcttattataccattctactaatttatcaatgataaatatttgttaaatgcatgttgtgtgctaggcattgcaccctgttctttatttacaaacatatgagttattattatctctgatttgtagatgaagaaattgagtttagagttaaatgattgcccaggattatgttgttacaagtgcagaatcagtaatcaaattgctgtgctgtgtcctccagggcctgagttcctacattgccatgagccattaaaggtaagatgctaattaaaggtatccatgactaattttaatggctaacacaagtttggtgaaattgatttaccataatattttggttactttttagggctactcagatacacatacttgaactgtaacagcaaatagtgagaggggaagtaaagattctgagcctcctttctgggtttacagcaatattttgaactaagaagatgaagtagaattagacatgagcaaagctccatccctttcttctgcaggtgagaaagaaatagagggtgtaggaggtaagcatacctacctagtaagccttcatgatttaggtatctggagcaggtgggactggagcaattgccatgaagttcacaattttagtgtggcctgtgatctgtttctttggctacagcttacatatcaggcctggggatttttctggattctgaaggttctagcttccagccttgaaattattctcctacttgtaggtcagtaaaacaagcgtttctttacttgaaagttttaagtcgacagttgccatgataaatcactcccactgatagtgttttagactttgttggttctaccttacgggattttcatagagtttctaaaagagaaagacaagcactagagtgaagaattgttcttattgtggaagaatcatcaaccttggctggacacacagatcaaggggttcagggatgggtggcaaaggatcattgagagggttacatgtgacccttgcctaactatagtagttaattcaactctgcctacacaatgacacggattaccgaggatatgacttgtattatactcatccctctgaccccacatcctaatgttaataatgattcttaaacctggaattgagaactcaaatataaaccagtgcccagcacatagcaagtcatcaattaagtttattgaattaaattaaatattggaattgtatctgtcaaagccatatcagctctaagcttcttaagagaaaaatctgcccagaatttctcaggagggatttctcaacatcgaagctgtcctgttcatattggatttattgtacttacataaacaggaatacacgagcagggaagatcagatcagttaccacaataagggttttgtaccatgatatacatcattttcgctcccctaggaaagcactgctgatgaaaacaattttggagggaggtggtctcaacagagtagatgttcaggtggaggttatctctggtgctctgggcttcttattcataattttctcttatgaaagagagtggttttcaacttcacaattcctttgctcatttggaaatatagtagcagaaagatgaagagagtttgtgacccacaactaaagtctgtgttctcttgtcacttcatcaaattagttctggtggcatttggttcccccccagaaataaatcactgttaaatgattctttataaagcagtccacacatttatcataccacagtgatctgaacccatttagggaattataagctacagttggtcatgttgcaggcctagcaactctggccttgtcacattgcatctctctccactccctgtgctaccactaatccttcaggactgagattcaaggctttgctagtaagaggcttggaaataatcatataaaacataatagtgtggcaaggtgagatcgagcttttaatttttttaagttcacagagagcaagaagacagataggaaaggaccggcagattgggaaaaatcaggaataagatgaaatatcctcagaactttagcttttatgattccacctcacattcagtttaattatgaaatttactggcagtgacaattggcttttggcataaattaatcatgccaagcattatacatgaaatgaaatttcaatcctatttgttgaacattttctaagagcttggcaatcttgcccagcactttacgtagggtttctccttatctaccttatgaaatatgttattattattcccacttttaatatgagaatatttggggattagaaggcttaagtaatttgacaaaggtcatatgggctagcataatagactagaaaacaaactcaggatgctgtaattactacactggaatcattcttagttttttttttttaaatgaagttggcattagttttgttttttaatctttaatacttttatctgagaattgataattaaccattttaagaaaatagttacataaatttagaaatcatttggaaaacaggtaaaattgctacattatttcaatttattttatttttaaaataaatgatattttttatctatatttgagggctatatgagaacctaagacttctattgatgttaattattgacttttatttactgtagttttagtgaataatttaattgacttctattaattcagtcatcatatgctaaacctagagtaactgctgttaatatttttttttttagctactacaaattgaagtatttttgattagagtaaaatttatttctaaaggtaacctgagtaatatctctatgttgtagatagatattactatctatagtaatatctatgcatatagtatctatgtagtagctttccaatttattttgctattatctaaaataagaaatacattttatattgttccagtaaatgcacacatataaacacatatatatgaaattgatacttcataaaatattagttacccttattataatcagtgctcacttgatattttacattttatcccattgtaaaatagatactggtcatgactcacagtattgatttcataactccctaatggttgtagcctgcagtttatcatttgttcaaatgtagtgtggtgggaaagaaagatgatatgactcttcagacagagaggtctggtccctaccctgatatgtgtcagttatatgtcaccttacctataaaatggtgattatcagtacttctcaggggagttgtaaagcctggtacctagtagataattagtaaatatcagtttcttttgtctttagagctcacacttcattccatagttttttgttgttgttttgttttgtttttttgagacggaggctcactctgtcgcccaggctggagtgcagtcgtgatcttggctcattgcaacctctgcctcctgggttcaagcgattctcctgcctcagcctcccgagtagctggaactataggcactcaccaccatgcccagctaatttttgtatttttagtagagatggggtttcatcatattggccaggatggtcttgatctcttgacctcgtgatccacccaccttggcctcccaaagtgctgggattataggagtgagccactgtgcctggcctcattccatagtattatagaaaatgtcgaactgtttaagcattccagcactttattttttaattgttattatttttctaccctcagcatgcatcagaggagcattccagccctttagtttggattttcttgctatttctgattttaactatgtgtgttcttcatatcttggactaaaaaataaaaacaaattaaaaatagcaaaaaaaaaaatttgcagtaattttaacagaccaacattaagtactctggaagccagaccagaagctaggggctcgttaatttttatgtatcatcaatggaaatgacttttatttgttaattattttttatgaccacctattgtaacatcttccaacacatatttccccctctttcccgtcctccactctttaaccttccttgcccattttttgtagagatgccagtgaggtctttctcagtcagtgcttcaatcccattatttcccatctcaacaggcttcactggctcaccattatctttcatattagtcacaggctcctcagcctgaattgaggcctttatgacacaattctagtctacctttggagatgtgcttcctttcagtgtcctctctgtatttcatacttactgctttgatcagacaagatggcctgtctttttccaaatggatctcacaatttccaggctctgtgtatttgcttatgttgtatcctctacctagaagtcttttctcctggtccatctgtcctcattaaaaactccactcctgttttcaaattccttgtctgtttcatcgtgactcttctaattgattctctttcactcccacactacttctattgatgttgatttctctgaagctggctcctagtgccttttttcttcttaaggcatgatagtgtgtctcaagttggaatgatttcatggctcccatatggttgattggttgtgggactttatcgctaatgataattcagaaaatagtagtaggactaattgcaattctgcagatttcaccttaaacatatgctgcttcttgggctgtggaagttggacacattgagataagattattcagaaaaacagcaaggccgggcgcagtggctccctcccataatctcagcactttgggaggcctaggtgagagggtcgcttgagcccaggagtttgagagtagcctgggcattataggggtaccctgtctctacagaaaataaaaaaaaaaaattagccttggtggtgtgtgcctgtagtcccagctactcagatggccggggtagaaatcacttgagctcagaagacacaggttgcagtgagctgagattgcaccactgcacttcagcctgggtgacagagcgagcccctgtctcaaaaaaaaaaagaaaagaaaagaaaaaaatattagtaggtctaactgtaattttctaacttctggttttaaatatacactgtttcttgggcagtgacagtagggtaaaattacccagtttgtgtaaatcttatgaggcttgataaatggacttaataattatcagatgacgaaattaaatgagtcggtgaatgttaatgcgtccctccttccatgtaactagatgccttgggacagttccaatatgtggcatttatattgtattatgatgtgttaataatgtggatcagagacaagcaaaagtcaaggataaatgtaatttcctgtgaaatgtatatttaatactttttaacatttagcggaattacctttggatgtcaattgaacattacatccccttactaccgtgactgtgtgtgtgtgtgtgtgtgtgtgtgtgttgggggggtggtgtctaaggagtaaatctattctcttactgcaatttcaaacactgaagtattataaactttctttaattgtatcgagttttatatattttgttgattctaagagtttttgtgtatgtgtgtgatatcagtgaatcaggcaaatttcccagtgtgtgaagcttttgggtcagctattaggttattacatcatttcagaaatgctccgtctgccttctggtggccttcagatttggccaagtagtggagtagtgcaaagactgctaatattgtagaaatcccgtgaccatacgcagtggtttttattttgttctaaggggtacacacttccatttgtctgttttcatgcggagcacatttatatgagggtaagttcaatggcaacttttagtctgtagagggatacgttgagaaatatgttactgaccataaattaccaatttgagatgaatgcatacttcagaggccccactagctcacatttttactgctgtcccctaaaagcaccttcaggtttatatgctgaagatggagaccttcatagttagaaaattgcattccctcaggccacaggaaatattgcttgacattctgtaacactatttgatgttcttaaaacagcatgctatgtagatactactctaggtcatgtctaattttttaatctgtatttataaatactatgaagcttgtggtttttaagaatagtaatgtttacatttatataatttgatgcaatgacttttccctgtaatataaaattaatttaatgtttagtataaaggaaataaccaggttgtatagttgtaggttgtgcaactacaggttgtgtagttgcaggttgtgtagttgacttgtgtattttcacttcctcatactgacaacataaccagaggcctgaccaatgctggtgaaataaccaaaaaggttgtcaggcagacctttgcgttttaatgcaaattcaacagggaatggggtgggcatagcttttttttttttttctgtattatatcaagtaagctgaatatatgcaaggttagagtttaaatgtaatgattagttttattcatatacatttaaaatctaatattctacaagatgcttagcaccatacttgacacattgtgagcattcagtaaactgatgttatcctttaagaagcatttaccacagaggttaagagcatatgctctagagcaaagttgcctaaactatttctgcctctgtttcatcatttctaatatagggatagatcatttagttcatagaacactgttaaatccatataaagcatctataacagtgtttttaataagtaaaaaaaagtcagctaaatattagttgtttattaattgtaatatatcctaaagcaacttatttcttaacgtagacttctgcacattcttggaaaattaatatctctttttttccttgcaatttttttggatatttgaaactataagtatcttcacccagttgtaggacatatgtttttctattttcttcccccttgttggagaaatctatttctacgggacaagctggttatttgtctacagatcctcccctggggattctgtagcagctacttcaaagctatctcagcttgcacttaatcatttgaaacatcagataacttgcttgttcattttatgcatgttttcttattgaggaaattagtcaacctaaaatgagcaccagaagattatttttcttggttttactcttaaagtcattctcaagcatgttatcttggaagagcagggcactctcctgcagcttttaaggatgactgaactggagaacattctgtttaaccacaaaactcatgttccctctgtttaatttcttaaagcttgccctcccttcaatgcaattaccatttttcttacacattaagaggacaaaatttgttggcttcctctttgggggaggatgtttatttatttagaagatactttttgagttcctactggtccaccgggaactatcgtaagtaagttgaggatacagggatgagcaaaatggacaaattctttgttctcatggaccccacaggagaagaaagacaatagctagtaagcaagtaatacatttttttagacagctaatttttgtatttttagtagagatggggttttgccatgttggccgggctggtctggaactcctgacctcaagtgatccgcccacctcagcctcccaaagtgccgggattacaggcatgagccacttcgcctggccaacaagtaaatatttttgactatgtggaaatatgatgaagaaaatgatgaataggaaaatgggactaagaggcaagaagggcgaagcatctatgaggaagtggtatgtggacagagatttgaatgctgacagggaggcagctaagagactctctgaacaaagaagtatccaggcagaaggaacagcatgggccagggctctggggccaaaacaagctcagtctggctgagaaagggaataaatgactgaacacatttctgtagccttctatgttccaggtgctatccaaggtgcttgggatacgtcagccaacatatttgcaatgttttgcatagttgtcctctccaaaactcatgtcgaaatttaatccccagtgtagcagaattgagaattggggcctttaagaggtgattagaccctgagggatctgccctcaagaatggattcatccactcatggattaatggattaatgactaatggactaatgagttgtcatgaaagtgggactggtggctttataagaagaggaaaacagacctgagctaggacactcagtcatgtgacagcctgtgccaccttgggaccctgctgagagtccccaccagcaagaaggccctcaccagatgtggcttctttattttggacttctcagccttcataactgtaagaaataaatttcttttctttatgaattacccagtttcagtttattttgttaacagcaacaggctaagacaataatgcatgattttttctaagtaaattatgtacaatattaactgatcagtgttttaaaaaaatgtttgtatgcagggaggtaagagtgcaggaataggtgggctacagtgtaaaacactgaggtcaaggtaggtctcatagagcaggtggcatttaaacaaagtattgaaggagacggggcaagtttgtcagatgggtatgtgggagaaggaattaccaggcacaggtaatagctagtacaaaagccgtaaggtagcagtaggcccagcttgttccaagtgcctcaagaaagcctctgtaactggaacagagtgagtgagatgagtgaggcggagaagaggttagagaagtgataagaggtggcatcaggccagtctttgtaaaccactgtcaggacttccgtttgattgaaacgaggtgccgtctggtaggtagctttggggtctagactggggaggggtggagcaaagttaggagcagggtgacttgttagcagaataatggaataagccatgagccacactctggttgctcttacagggccgtggtagagatgatgggactttgtcagattctgaatatatttagaaggcttcagaagtgaagtatgagagaaagaagaatccaggatgtgactccaagtgttttgtcctgaaaaaatagaagattgagatgggaaagactagtgctggaacaggattggatgaggtgaggagtggctgtgtaaagcaggagacacccaccgttcccagggcgtagttctgtatctgccttcctgagttaggcttggcagtacgactggctctggccggtgggtcatgtcgatgtgagacaaaagcagggtacggaaatgtactcccagatcgggctcagcctcttgtgatgcagtcattttcatgagaagagctttcctggggcagacgttgccctcttagcctggaccccaagtgaatgcaagtgacacagagccaccccagctaagcccagctcatcccacatttggaaggagggctgcccatggagcctgctttagattaccagaccctacagaatcaagagaattaatagctactgttgtaagccaatgagtttggaggtggtctgttatgcagaagttttgtggcaatagctcagtaatagagaatccagggagtgaagtgaaatagggagttggatataggagtctggagttgagaagaagtcttggttggagacaaaaatgtaagcgtcattggcataccaatggtatttaaaacctcaaggcaaatgagatcaccatgggagtgaatgtagtagagagggtgaccgaagattgcatgactacatcattacaatgtctggaagaagaggagcaacccatgaggaggaaggaaaatgccctacaaatgaaatggatgaaaacaatatctaggaggaggaagtgacaaatgatgtcaaaggcaactgccaagaattggtcattggatgtggtaacctggggagaattgttgactttgataaatacagttttatgggagtgttggaggtgcaagcctgattagagtgattttaaacacgaatataggcggagagcaactggagatagagagcaaagtaactttttgaggagtttgtgggaaggagacagaaatgaaatgaaacaatggcctcctcacaaaaggagcgcgaaaccatggtaagggtgtactttattctgagcggggaggtagttgaagcgtttaaataatgacctatttgtcttttagatattgctctgactgctgtatagagaatggcgtggggtgaaagggagcagaacagttataaggctatttctgtttcctaggtgagagagtgtgttggcttcagctgtagccctggaaatgtggaaagtcatgtgtaaatttcacatggggtaatggtattaggtagacagcagtgtgggatctttagcttaaggaacttaaaaaagtgtttgtgatcaaatgaaaaatcacaaatgtatatgagaattatgttttgtaacttctctttagctctaccttatcttatataaatcatactggtttgaagcaatatatattggttactttattaaaatttacattctgttatttttttaaataattcctgttgtctatgataaaatggatatgactggccaggcatggtgtctgacgcctgtaatcccagcaatttaggaggccaaggcaggaggatcacttgaggtcaagagttcgagaccagcatggccaacatggtgaaaccccgtctctacaaaaaatacaaacattaaccggatgtggtggtgggcgcctgtaatccccagctactcatgaagctgaggcaggagaattgcttgaacccaggaggtggagattgcagtgagccagtcgtgcctgcactccagcctgggtgacaaagtgacactgtctcaaaaaaaaaaaaaataaaagtggatatggtaatttttctcctttccaaattatattttgttccatcctggatcattcagtctacactggcgtatttcgctcaagtgacattagagatggtttctggcataatatccttgtctgagtctgtgtgcaaaataacttttttaaaaagtggaataagttctatgatctgtagttgggatagggattaaacaacaacagcaaaacagacttttacttccttagatctcagatttatatgtatagagaattggttttacacaaatagtgaataaagtattttgccaagtgtgctttcagtagagacttgaatgattgtgatctgttttgctcttattccacgttcagaggttcccatgggaaccactcccaattcgtgggaagagtggaatttaacaaacaatacagaaaagccatttaatcatcctctgtgtgatccacaaaagtgccagaaatacggaggaaatgaaatcactagaatctctatctgtatgggcctgcccagagaaaaaagtgctgctcatggtaaatagatttgatagatggcagaaaaacaccagtgtcctaaatctgacagtaacaaaaaacctctcccatcatccatctccttcagataccttttcaaaatttgttaagtgttttgtgtcctagagtttggcatcttgccattttaatttaactatttttcccctgaaagatttgtttccagaaaaagcttgggatcataatacagtaaaccttacacataatcttctcattatgttcagaaagctaattttaaacctaattttcccatctctgtctctctctattccagtgcttacctgcctgcattaattaattcctgtgcagcaatgaaaatttgactcagttacctgacctcttaccttctgattgcagaggctctgtctcttacaggggtgtgggacgcctggtgccacaggacatgtgaacacagattatccgtacctgggaggtgactttggtgagatcggagacattggagtcccccaggagcagctcctcagcagattggggataagaacagagggcacctacaacaatctatgtattacagaacacagctctttttcttttgcgaacacagctgtttttcttttgcctgacttgactgaaaactgtttttaagtgaattaagtgttttaagtgaattaggtgtttcagctatgtcgccagtgggcactgaatcctaaaacagtgatctggaagggtcttggtgaccatgctatccaagcaccatgagatttggacctccaagttgggttcatcttctcactctccccgtgctctctactgtgaaaccacattggtcttcgcttcctccaacacagctagctcttgtctgcaccagagtctttgaactgtggtgcgttttacgtgaaatacctccaaatgattcttgttcatccttaagatctcagaatagatgtcatttcctcagaaagcaccaccttcttgaccctccagcctacaggaggattccctggactgtgttgtcatagcacctttgcttttccatcaaaatatttaacatagttcataaattgtttcatagatgagggggtggttagctcgggttgctttttctcttctccagtaagagatttcagaatcactccccttagaatcatttatatgaggttttcccctgagggcaggccagtggcctcactgcttcagaagggggtgtaatcagggtgaagagcaaaaatgcttggtatctttgagggaaaagaaatgaagttttggagagctggtaggtgccagagccgttcctgcctcagtgcttccataaccagctggggacttaggaggtggctgtttgtgggattcaaaaaacggaaccatgggaaccttggaagcccaagtgctgggcgtcttcgatgagcttagcattcagaagagaaattgcgcttcataggccatgtggggtctgtgcataaacctgtatacagcagagttcattgcagcaatggtcccgcgccttcctcagcagcgtcctcaagcagcgccaccgtgtggcagcagtaagcaatggcagtgatcggattcctgtccactccctggtgtggatgtcctcggcggacttcctgtccattacgcatgtgggacatcaagagataaatcggaaaaataagaaatacaactgtatatgaagcccggtttggagaggcatttgtttgcataagtctgtaagatccgttgtagaccctcggtaaatgtttgttttggagatgaggaaatggaggcagagagaaggcaagtcatttatcacagacagcgttaactctgggcagagttaggataagaatatgtgaatcttctggccccagttttggtagttctgcagttgaaagataccatgaagaaggatgatgtgtattaagagaccatgatccgatcactctttatgagattactaagagctatggattgctagggctattcctggctatttggggagagggaagtctgaccctcttggatgcttattttatctctggcaaccattttggggtcattaatatttctcatctgcatgtctgtacctcttccttccagttttcctaatgaccttcttcctttttgcctgcctccttgcatttccgtttcgttggtttaccaaatagatttcattgtgagatatgtgtgtcattgagtcaaatgtatcttcactaaaagagaagttctggttcctgttctgaaatttctgtcttacacatttaaaaatggaagaagatatttaaaagtaaaataaattaaataagcacacattaatataatgagattacataagacctggtggataatatgtgagactgggttgagattgatgagtgatggcttcttagaggagaaagattttaaagatatgcgatatgaaagtagagggaggaggtgtgcactccgacgagaaatgagacaggtggggaagtccagtgtacatgtgtttacggggttagtgagaagagagttggcaaaagtgtatgggattattcagaacaatctgaggaaaagatatctggcttagggaaggagttcctggagtcaatggagacttaagctgttaaaggaaaataaaagtgaaaaaaatgaaaaaaactttggagtagtttttgggctcaaaatctcactttactgttactatctgggtgactttggacaaggtatttaagatatgaatgtgttttctcatctacaaaaatgtgcttttgtgaaaatcaagtaaaatgtcctatgagatgccctaaaacaatactggcctagaggaggtgttcaataaatgtaacttttacactttataccaatttcaaattctcatcactaagttatagtttcaaatgaatgttttcagtttatcttgatgttgctcctgacttcaaaattttctgtttggattttcttagaaattaataatctttcacacatagctatcaaataaatcattgttttcatttaagaaacatggataaattggcacacacacaaaatcattctcagaaatctatcaaaaccaattaaaggaaccccaaattaggaaggacaattgcatttgtcatgaaattagagtggagcctcagcctcaaaccctaaattacaaagactagtttttgaattcaatttaatagaagcttccaggatttcatacatatgttctttaattttgcatatactgcatatatgggaaatgagaatgcttgaaggggcttttaaaccctggtaattaggacagggtggcaaagtgacacatcaaagtttatgttccagaaataaaaaagaaacttgtgacaaatgacttacaaagggcgaattttttccccaaaagtattaatgtaagaagtttagatatgtttctaaaagtctaccatccctcattatttgtccatcattatttcagtacaaacatacccaatgtttcataaaatatatttcattaataattaagacagacaagctttgatttaacaatttcttaccatatgaatgtggttgtggtctcaaccactggtaaaagaattatgggggacacattcagctgctgcaataaagacaaccattgtaaatgcttacctcttagatgaaaatggttgggccggatgtcctcctattgtttgctcttccacatctgaaaagaacgtagactaaatggagtgaatcctcactgatacatggaagtgaatatgtccacattggcagcattcataaacagcagcaggtttccttaatatgagaatcagagtagttacagcatagatgagtttttgagcctgcatagaaaaagtccagaaaacatgcagcacgcactgctggtgagcattaactcactcttgtcatttgggaaagagaacccattgtttctagatcttcaatttctgcagaaaagcatggagtctgttactcttcatttttttgttttgtttgttttgtttttggaagagtgaaatctccagctttaaaaatgttggcaacaaatacaacattctttttaaagcatagtcagtgtaagcatcgttggtgggctagacaggacatacctgtgagccagatttgactcacaggctttcagtttgcagtctctgaggtctagtgtatgaagttggaatcccgagaggcagcgagtgggagaaaatgaaggctcagaacaagtcagacctcttgtagcaggcctataacttcttcctggagcaccttgactctcttagcaccatacaggatctgatctgagagagagttgtgtaagattgatgctccagaattatactgtatacttttgaccagaatattttcattttcagtatgaacacattgctctcttaagtattttttgcatttgtaaaagaaaataataagccccaacatatccctgaagcttacaatatctgtgccccaaactcttccttatgaactttcttaatattttaacaatatcaaaacagaaaaaaaattgttaggcataaattatctacttactctgacctatatcgggttctttttcaagcttttcaaaaggtgacacaaaagccagttcaacctgaatattggaaaagaattgcaggggtctctgagcattgggaaaggatacaaaaggcatcagaagtttggctttgagacagttgccatgaaaggtatctcattttcctgccctggagattttatattaaatggattatctgtctgtcaagcattttgagcattccccttcactgctttccctgaggactattgcagcatcttaccgtgtgaggtgggccatatttttttttgcagatgatttatagaatatgagatatataagcagccgttaacacatctagttttatttttaaagttatgtttgaatggattatgtttgtcccacaatcattttttaatctgaataataaggtcaatttgacacagctctttttttttttttaacatttagtttaatcctttaacaaaccttgccctcatttctgtttaaccttggaccacctgctttggctggttatgtaatttgcaaattagaaaatgactatttcttttttcttgttattggactccaaaactcacccaaattctttttctttgctttgtgtttcctctctgtcttcctaatttcttatgcctgtattaataaaatggcttgagagataatagtctagttaaatgcatagtttcctaatttgcttatggaaaagctaaagtagactggaaagaacatgttactaaattataattttaaattttttatcattgaatgtcagtctcactgtgatccttttatgactctataaatatgctttcttttgaatgctggaggtggaaggcaggttggcggtcacctggactaaaaccatcgttttactgaaaaagcaattgtgaactaaataggagaggtctcttggccaaggtcaaacataagctggtggcaaaatcaggagagagtcttgtatcctggttaagaggtataaggatccagagtcagacaaaactccatgtcctggatggccttatattagttatcttgctatgacttctggcaagtcaaataacttttctgagcctcagtttcaaaaattttaaaatgaagattatcatattgctcactgttatttataatgtggaataagtgatagattccacatcaactgcgtgacatctaacacctagtaagctctcagtaagttgttactgttattgctgcatctctcataatcatcactctgatcacctgtctatgtttgtgtcatcacacagctctagcaatgtttccaaaccaaagaaagggtcccttaaacttcctcagcaagggcttggcatctgttgtcatttgttgactgtttctcagatggttcaggaatgtatacggtgcgtattattaagtttgcagctccccttgatttccattcgtcacatttggtccataaattcaatcaatatgtattgaacaccttccttctgtacacaaagctctactagatccctaggatacagggtgaacaagaaggtataatccctcttgcctggggcttatgtttggagttgggagaatagaagctaaataactaatcatactgttgtttacttatggttgtgttcagtggttaaagttgagtaccaagtgctatgagtgagtaaaagaggggagtcaaagatggaggcttctcggacaagtaggtcttagctaggcatgacctaaggtataattatttttattttgaagggatggtatctgaggaggtacaggaagcagaagtcattgaaattttagggatgaatagaaagtcattgtggctgaagcaaggggatgctggaggataagggtggaaaggaaggaggggctgaaacattaatttttaggccatgttaagttttctgggctgcattataagaaaataaatggaatgttattgaaaggttatacacagaaaaatatcatcaccagatcttttataaagataattttagtgcttcatgaagaacaagtagaggaagcagagagaactgcttggggtcggggtggcttgtaatagagtgggggcagtggaggtggagagagatctgagaaatacaaagaggtacaaggaaccagcctggtgtgtgactggtgtgtcagtggaggcagagagagatgtcaagaatgactccacttttgacatgaactccagtcatcatgaatgttggagtaagactggtccatgatcatatttttttcctggtgaaataaagcacggaggagttctgagttctggaaaaagaccgattgaaatgagaggtgaaaagagaacgctaagtacgatgaggacagaagacatactttaaatatgttaagtagtaagaacatcaaatactaggagccagtatagttaagttacgaattgtgaggtttgtgtatgttagagttgaggaattcctgtttcttgctgttttgatgggcacagtgttcttccacgacagtaatcagataaactacttaggtcaactcaattaatctcttttaaaagaagcctggaataatctgctccgttctttgacataaattgattgattagaatgtttgcatccccaaattaaggtaaaaccactgccattttacagaaggtattgatcttatgtctgttaaaattgtatctttaaattttttaatttagttttattctttttcaatgagaatacagatttcaaactaaatgtagtgtaggtgtgaatgataataaaataccacataatttagtgtagttttcctatacgcattatattcatttcagcgcattatgatttcaactgtgtttgtacttgaattactcatttttgtttatcaacatgaggtttccatctgatccagaatcaaatagtttttattcagagttctattcatttactaaaaataatttcttatgaatgttctcatatatgcacatgcatgcatgttttaaaaagataacagaatcctgttattgccaagaaatttgggggtaagaccatggtggcaatttaagcaggttttgttttgttttagttttgtttttgagatctttatttctcccagctacctatcaaataatataggagggaaaactgtgtcccacaactggaaaacccataaggctccccagtcatctacctcaaatcttgaggagtctccagagctatcattgtgcaaagagatgtgggggagctgttctgacctgtttattgactcaatagtatgtgtcattcaaatttagggaatggagaaagatgctgttgccattctgctggccatgttacttgtcaaagcccataaccacgaatgtttggagaaaatttaaagttgaatataggagagaacaataatgatatggaagtttcctgtactactcaggaggatatcacatttatcaaataaaagaaacaataagaaaacagggctgggtgtggtggctcaggcctgtagtcccagcactttgggaggcagaggcgggtgggtggcttgagtccaggagtttgtgaccagcctgggcaacatagggagaccccatctctacaaaatatataaaaattagctgggtgtggtagtgcacacgtgtagtcacagctactctggaggctgaggtggaaggctagcttgaagccaggaggctgaagttgcagtgagcgaaggtcatgccactgcaccccagcctgagcagcaaaacaagaccctgtctcaaattatactacaaggctatagttaccaaatcagcatggtactggtataaaaatagccaagtaaaccagtggaacagaatagggaacccagaaataaagccaaatactcatagccaactgatcttcaacaaagcatacaaaagcataaagtgaggaaaagacaccttattcaataaatggtgcagggaaaactggcaagccacatgtagaagaatgaagctgtgtcctcatctctcaccttatacaaaaatcaactcaagattcatcaaagacttaaatctaagacatgaaaccatagaaattctagaagatacatcagaaaaactcttgtagatattggcttagggaaagaattcatgactaaggacccaaaagcaaatgtaagaaaaaccaaaataaataaatgagacctaattaaactaaaaagcttctgcacagcaaaagaaatagtcagcaagtaaatagacaacccgcagaatgggagaaaatatttgcaaactatgcatctgacaaaggactaaaatatcgagaatctgcaaggaactcaagaaaaaaaaaactaataatcccatcaaaaagtgggcaaaggacatgaatagacaattcacaaatggagatacacaaacagccaataaacatatgaaaaaatgcttcacatcactagttatcagggaaatgcaaaataaaaccataacgagatataatctcacacaagtcaaaatgactgttattaaaaagtcaaaaaataatagatattggcctgaaagtggtgaaaaggtaacacttttacactgctggtgagaatgtaaactagtacaaccactgtggaaaacagtatggagattccttaaggaactaaaagagagagctaagctgtgaggctgcaaaggtataacaatgataaaatggactttggggattcaggggaaagggtaggaggtggatgggggataaaagactacatgttgggtacaatgtacactgcttgggtgatgagtgcaccaaaatcccagaaatcaccactaaagaactatctgtgtaacaagaaaccacctgtacccccacaactattgaaataaaaaagaaaaaaaggaaagcaaaattaaaacaaagaagaaagagagattgcttgaggaaaaaaaaaacaacaacaaagtataccctttagtagagatagtaaatatcagaatggatgctactgaccaaattaattaactggaaggctgagaaaattcgcataactgtaagtaaaaaagaggttttataagagagaggatgacgcacataggataggtcttggggctcatctcataactaataataggaattttagaaatagagaacagatgagaggaaggaggagaactaacagattaccatttcctctaagccaaacctaattcttcaagccttcacattgaatgacctcactacaagctggtgaagattaatgaaaataaaaacttttagacataccatgatggaattttgaattccaaggtaaagagaaaatgtatacaaaagttgacacagaaaaacaattagttaccttcaaggaaaagagaatttgactattatccagtttctcatctgccacagaaaatgctagtggacaatgcaacattcctttcagaactgtgagtaaaaagggttgcaatcatagtattctctcaccagacacagtttgctcatgtttgacggaaaaatgtgcgttttgatacatgaaaggactcaaagtattctgcaaatgtactgtttaaaaaaaacaaaacaaaacaaaaggaggtagtaggaggagacttaaggatgtactatagccaaaatgaaaatgagtcaaaatatatcacaaataggtcacaatatgagaaggggtgcaagatatatgggtcacaaatgctgctacaagactggccctgggcagattgcattaatatcacctaaggtggccaggcctggtggctcccgcctgtaatcgcagcactttgggaggctgaagcaggtggatcatctgaggtcaggaggtcgagaccagcctggccaacatggtgaaaccccatctctactaaaaatacaaaaattagctgggtgtgatggcgggctcctgtaatcccagctactccagaggctgaggcaggagaattgcttgaacccaggaggcagaggttgcagtgagctgagatcgcgccattgcactccagcctgggtgacaagagcaagactgcatcttaaaaaaaaaaaaagacaaaacaaaaaccacctaatgagattttctttccccagctttattgaagaataattgaaaaataaaaattgtttacattcaaggtatacaacttgattattttgacatgtgtgtacattgtgacaagattaccacaatcaagttagttaacatcttcatcacctcacatagttacctttttttgttgtggtgagaatacttaagacgtactctctttgtaaatttcaagtatacaatacattattactaactatattcaccatgctgtacattaggtatccagaaatcattcattcattaggtatccagaaattattcaaagtttgtgccctttgaccaaaacctccctgttacccccacacctgccccctggtaaccaccattctattttctgtttctatgggttcaactcttttggattccacatataagtgagatcacgcagtatttttctttctgtgcctggcttacttcactttgcataataatgtcctctaggctcattgatgttgcaactggcagaattttttttaagactgaaaaatgttcagctgtgtggaatattatattactattaatattatatgctatattttatatataccacaattgtgatgggtgtaccacaatttcttcaatatcagggctattttgaataatgctgtaatgaacgtggaagttcatctgtctcttcgagagagctattttatttcttttggatatatacccagaagtggaattgctgggtcatatgactgttctatttttaactttttgaggaatctttactgttttgcataatggtatattcattataatgcataatgtcaatttatatccccatcaacagtgtttaagggcttcgttttcaccacatccttgctcaacattagtattcatcagggaaacgcaaatcaaaaccacaatgaaatctcatctcacacctgttaggattttttttggttattatctattatttttgataataattattatcaaaaagtgaaaagataacaagcaagggaattctgccaaggagactttaaatgctgattcctggagtccaaagtgagagattatgagagtgtaaacctgagataggtcccagtagtctgtatttttaataagttctccaagtcacctgacagccaaatttggtaacctgagagtaatgagttcagtaaaatatattacaattaaattattattgataatgtaagttatgaaatattaatgaaatggttaagaaaggatcctcaactgcaaggacaaaaatgcaatcatttttgtctgaaagtaaattctagcttatttcaagagaatctaggtgctgtgtgtatgttgtgaatgctgtgtagtgtaagggaatcactgaagacttagaagcttgtaaatgcctagccttgttcctgaagggggagctcttagagaccgtttagtcattgagattgatggagaaacattacttacatatgcttatatatttaaagattaccaacagtgaaatacaaataagatgaatagctccttaatggctagagaatgcaaaataacacataagaaaaagaaagcttcgatagtagagtaaaaatttggaagaaagaaacgagaaaatataaacaaacaactatgagtgatagaatgtagtttgatagtagtaatcatttcactatgtatatgtatatcaaaatattatgttgtgtacatcagacatagatgtaataaaaataaatttaaaaatatatatgcaagttacaattaaagtaggtaaattaaatcttaaattacaaaacatttttgcattagcttaagaaggataaaccaattccatgctgtttaaaagaagactttttttttaaatggcacaaagtaattggaaagtttttcactattatatctgcagctcttggcatgattggacatatggttcaaaaatgattgccacctcatggaatgaatggatgtggaaaagtataacagcctcctatcacaaccacaaccaaaaataaaaaggtaacgtgtaacaataccattattacaatacacttcaaataataaataattagatggcacatagggctatttttaccaaaaaatccaccattaaacaaggtataatagcatcaaacttttgtgcactgaaggacacacattatgatgaattggaaacataaacattcaagaagaaattaacaaaactattaccagactgggaaattttaatacatctctcagaattggactagtcaaaaaaatccaagacaaatgatgtaatattttccacaatattaagctcataccaatgctttgataaccataagctttttaccttgtcatttaataacattttaattgtaaaataaagtaaatatgatgactaaaagtaaatgaaaacattcgaacaaaatacttctttgttttcaccctggcccattttaatatgtccacttggcttctaatagtatatgatgtttccctttcctcgtttgagaacccctggtttgaatattacagttcagttaagatttatttcaagaccaggcatggtggcttatgcctgtaatccctgaagcagaaggatcacttgaggctaggcgttcaacagaccaagcaacataggaagactccatctctacaaaaaattttaaaacattagctgggcatggtgttgtgtgcctatggttctagctaggctgagccaggaggatcgcttgagtccaggagttaaaggttatagtaagctatgatgaggccattgcaccccactctgacctgggtgacagagtaagaccttgcctccatggttggaaagttatactctacaaatgtagactgtatattgtttcaaaaatgtttttggaatgtttatgaaatttgatcatatatgtaaagaaaatttcaaatattaaatattaaaaatcttataggttatattgtctaattaaagagcaataaaattataaattagcaaggaccaaaaatatgagctacttggaaattaaaattaaacttgtgaatggcttttgggtttaagtggaaatcaattatactatgaactatctttaaaacaagtcacagaaaataattattcaggattctaatatgtggtcagatgtttactgagagagatttttaaaaatgtaaatgcatcattcttaaatatgaaagattgaaattaagtaatctaaacatttaactcgagaggctagaaaatgacattataaaacaaaataaattaataaaaagtgaatagttatttaaaagtagaaattaatgacttgtttacatataaaatatatagaattaaaaataccccatatttgaaaagacttgtaaaatcaacaaagctttgttgtttctgattcaaaaaaatgagttcataaatgtatgatattaaatttaaaggagataggaccatttgtatgtaatacattttcaaaatcagtagtgcttgttatggatgtaatacttgcaagcagatttggtgatttgcttggaaaaagaaagaaccactttgttttttcgaaaagaaaaatttcctgcttaaatgaattgccaagataaagcaaattaaagattgtcttagatttaccctcagttctgcaaaatacacagattcagatggcttcctagttaagtgctgaagctcaagagacaaatcattaccaagtgatttaaaatgtttcagaattttaaaactaaaagtaatagggaacactttctatcttatttaaagttcatgttttgagagtctaatatatattgtgaaattttagaaaggctgtacgaagtaacattaaaaattgtagaccagcttccttattattactcttgtaaatatgattgaatcgcaggcatcatcaagttaaaagaatgatatacacttaccaagtatatttgttctaaaaatgcaagaagagttcagtattcagaggtatattaatataattatttataatacattgaaaagataaattccacatctctattttgaaagatgtttaacgccttttgatgaaatcaaatcgacattccccagtaacatttttagaacattaggaatgataaaataaactttttttttttgagacggagtctggctctgtcactcaggctggagtgcggtggcgcgatctcggctcactgcaagctccgcctcccgggttcccgccattctcctgcctcagcctcccgagtagctgggactacaggcgccgccaccacgcccggctgatttttttgtagagacggggtttcaccctgctagccaggatggtctcgatctcctgacctcgtgatccacccgcctccgcctcccaaagtgctgggattacaggcgtgagccaccgcgcccggcctagaaactttaaagctattatgaaagatatgaaaaacagtagtgaatataacaattcactgtaaacagtaaaactgtttctgttttaagttaaagaacaaatactctttatcaatgctcttagtcaacaatgctctgaagattatagttggtaaaatgaaaacagaattaagaataaataatgggaaaggacaaatattactattttcagattgtatatgggttcttcaataaatttttacaattaaaagcttttagaactaatgagttcactacatgatgagagataagataaatgaaactagttattagctaatacttgcaagaatcaaaaaagtaagggaggccgggcgcggtggctcacgcctgtaatcccagcactttgggaggccgaggcgggaggatcacaaggtcaggagatcgagaccatcctggctaacacggtgaaaccccgtctctactaaaaatacaaaaaattagccgggcgtggtggcggcgcctgtagtcccagctactcgggaggctgaggcgggagaatggcgggaacccgggaggcggagcttgcagtgagccgagatcgcgccaccgcactccagcctgggcgacacaccaagactccgtctcaaaacaaaaaaacaacaacaacaaaaagaggaataatattatattcacagaagaaagaaatacaaaaaaattagaagtaaacttaggaaacttaggaaatcatcaagacctacatgaaaaaatagtaccattcactatatgatataaacaagtgcttgattgaaaagtaaacacactctcctcctaaatgggaagtcctgtcattctaaggatgtcacatgtgcccacattaatctgtaagtttactgaagttcaagtaaaaatctttacagtttttctgtttttgttttttgcttagaataaaggcagaacttaatgaacctaaatttgatttggagaaaaaagtgggtagagaaatgtagggagtgaacagagccttttggaagagggaatgggagactttactagatataaatatgaatgtaaaagccaaaatattttaaaatgtactgtcagtaaaaacttatgcagatgtagatggatcaatagaaatagaacaaaccgtagttataaatttaagtggatattaaatgtcatataaaatgaattgtaatatggattgataactcagcaaatactgaaaaaatggtctattttaatacttagatcaataccacttcaaacaaaagcacattactctgaaacttaaatatagaaataatcacatactactatacgaaaatacagaatgtttctaacttttaagcaaggacttcctcagcctgattttagtcgaataactataatagaggaagatgtttctttaaaaaactaaattctgtaaaacacgaattctttataaacacaaagtcatatataaacaaatgtttattgcagtattttttattacatccaaaaaccatgcacctaaatgtccaccaggaaatggacagataaataaaaatgatttgctcttaccaaaaatgttaaaataactttaaataatgataaggtgggtctacatgtatggacctggaaaaatgccattacattttcagaggacaaaaacactcataaaataggatgtaatatgtgatctcatttttataattccacgtctttgcatttttgtctgtcttttgtgtgtagaaaaagaaaataatgtgaaactaataccaacttcaagaattaaggggatgaaattacacagtggagatttttaactttatttttatatattctgaaatatttgaatggtgaacagtcattgctttaataattggaaaaagtagagctatttccaatttgggttaaaaaagtcagtgggacattatcgtctatattctacctgtatgattgagatcctaagccaaaccaattcttagagatattctgaatgacatatcccaaagcgcaggtaagtacactcactgttagactctgctcatagttatgagggaaacatagtctccagtcacatcaaaaaccatgaaagacaagaaaagatcattagtatactgtatttacttgagttacttactgaatagtatgtactgggctcttggtgtgtttggtattaatattgactgttgggttctagtctagactcttggttctgtggtgctgtcatctataccattggtccttggaacaggagcacctaggaacttgttagaaacagaaagtctcagacttcattcctgacctcgtgaatcagaaatttctggagcccacgctcaatcagcaagcactccaggtgattctgatggatccgaatgtttgagaaccactgctctgctgcatccaggggaaagctatttactaagtcaagttttattgtaagttgatctttctcttttgagtatatcagaatttattaagaatgattagaaaattgattgcaaaccaaagagtggataaagaaaatggggcatatatacaccatggaatactactcagccataaaaaaaaacgaaataatgtctttttcagcaacttagatggagctggaggccattattctaaatgaagtaactcagaaatggaaaaccaaacattgtatgttctcacttataagtgggagccaagctatgaggatgcaaaggcataagaatgatttaatggactttggggacttgaggggaagggtgaaatgggggtgaggcataaaagactacatattgggtacagtgttcattgcttgggtgatggctgcaacaaaatcccggaaatcaccactgaaggacttatccacgtaaccaaaaaccacctgtaccctaaaaacgattgaaataaaaaacaaaaaaaagaaaactggtggcaagtaggccagcccatgaaagccgtttaatacttggttaagtagactgacattcttttcgtagatggtagggagctttaaagatttctgaatgtgagaaggacatgagtggttgatgtccatcaggacaactgctctagctgcagtgtatagcagattgcaggagactgacagtggagatggagagccaagttagaaggcaattaaataggtcaagcaagaggtagtaaaaacctggattggagtagaggaaatggaattggaaaagagacaaatgagaaagagagattgtgaaagtgagaacagtgcttggtccctgatggcatgtaggggccaaaagagaagaaaggcaaagatgattgacgttttaagcctatgtgacaggtattattggcactacagatcagaacaactatcagtgatctgcaacgtggtagattgtgctgatatcagtcatcacacagaagattggtttgtttggatttctaaattggggcttttcagttcattggaaggatggttaaaaatctcaatgattagcattagaacaaaagagaacagaaatacagttgagtactttgccagactcatcaaatatgattttgatgggctaagaactcctaacgaggacacagtgatcaactgagcaaacagaccatttggcttgaacagaaatgtcaacataggcataatctactaagttgctaattagggatggtactagccggttgatggacttcagccaagacatacagaatggtgagaagccagtgcacagagcctctgggaatctgaatgatcaattatttttcatcccataatgtaatttacctgtattagaatttatatgcagaattaaacactccttcttcagagtttccacagtattctagatttttattgaagtatttattttaatggtttatttatcttgggcagagctttttgtggggatatcaaactgttaatggatagaaagggatagattgaatattcctgagagttggatcagtgtgaagtaaagttgaagttggttatactatggcaagtatgatgtagagaaaatctttcggatgttcgaaggtcaactcagctacttacttccttttataatttggttcgacttgaacactatgattcctcatttgttaaatagaaataataataatagtttacctcatagggttattataagaattaaatctaaaatccagttgacttgaactctaaaagataaaataaaatttgaaaaagaactaaaggaaaaaataattaaataaaattatgcatatgcaatgttaaaaaacagaatcggaaaaataatttctcaaagagggtagctgttgttgctattatcgttgttttattttattgtcaaacaggctgtgagagtcaactagaagggtgacgatcttgaggtaagaagtttttgcatccctctagcatattttacaagcagcatcaggtacaagctaaatgagtgtcgctgagcctgaacttgtttggtgagtagttgaataagggaatgataaggcccacattcatttatttttacttttaaggtagaagggtgcagcaacttggtttctgcagaatgtatcacttgctgtcttttccgtggaaaagaggctatagttgttcattcagattgaacaactgattgtaaaattgtaatacccctagatggaggtgtataagaaaactaagccatttcttttcttataaatatgcatacatgtcttagttcattcatgcttctctaacagcataacatagactgggtggcttataagcaacagacatttatttctcaaaattctggagactgggatttccaaatcaaggagctggcaaattggatgtctggtgagggcccacttctggttcatagccagccttcttctctctgagttctcacagggtgtaaaggaccaaggaactctcctgagtctctttgatgagggcactaatctcattcaaaagggttccaccctcatgatctaatcatctaccaaaggccttacctcctaatagtatctctgataggccagtcttgtgttgccagaaatgaacattctcaagttcatttcatgccagaaaggaatatctgagactgggtaatttattttaaaaagaggtttaattgactcacagttctgcaagtggtataagcatggcattggcatctgctcagcttctggagaggcctcagggagctttcagtcatggcagaaggcaaagcaggagcgggcacatcacatggcaaaagcaggagcaagagagtggggaagtgccacatattttcaaacaactgtatatggacactcattattgtaaggacagcacgaagccatgagggatcctcccccatgatccagtcacttcccaccaggccccatctccaaaactggagtttacaattcaacatgagatttgggtggggtcaaatgttccaactatatcactatcacattggtgattaggatttcagcatttgaatttgcaggggacataaatatttgatctatggaaatatgtataagacatttatttaatctataaaataagatctctaatgaatgtgttataaaaggtagcttctaggttcactgtcctattttaggaaacttgcaaatgttcattagtctcctaaacctctgccgatagcttgccttttctttgtgaccttggattttttttttgtaggattccctgtctagaatatcctagcttgtttttcctaaacatggaaatcactaatccttcatggccgagtttaccatccttctccttagtaatttcgctttatttcaacaaggaaaaaaagtctgagaaattctgtagcactttggtccattgttatgacatgcatttcaaatgacctaacactgtttatatttgtgtagaaattttatttatcttattagattgtaaactccatacaagaaagctgaaaaaataaaattaagaatacggggaaaggtttgaagcagaaggtcagagacagaggcttcttcaatgccatacagaggattgggcttgagtagtaactactgcttgataccagatgacttaatctctctaaccatgatgtaatgaaccagaggtgggtccctgtccccaaaggactgtgatccttaataagtgacttggtaagagctctggctaactggtgtgttgaaaatgtcacaacaccctaacctgatctgatcatacagacagaatgagcagagtgattggactaaagctaaaaggcagagagagggcaatgatattacaggcaagcagctagcacagcaaaaaattcaatgtaaataaaatagtagagttaggagaagattatctgccctctttaccaaccccttcatctttaagttaaatctcatgaactcaagttacctgaaaatatggtttattccatgtatgtgaaaaaaggcctgactagtacagcatcattttgtaatctctttggcagaaatgattctttttatatgttgagtctaaatgcactgccttgtagcttccatgcacaggtacttgtcatgcttcctgaaatcacacagaacatgcattaactatgtagccaatgacaggccttctaggatgagcagattcttcaacagtagggagatgtctttcacaggaaacgaatgagtatttgtcagggcttcacttgatatactttctaccactgtcccggtaaggaatagcagaatataaataaagggtctaatatgtacttattaatgagtttgctaaatagaatatatataccacttagtgagtggtactatgattgttttgggtacatacctaagattagcttttgttttaatagtagaaatatgtatatattattatgtatattaggaaaatataaccagcatggaaaacccatggcttccttgagtctattcattaagacaaatggaaaatacatatttaaatttaaaataagaatttaacaatgctaagtaaacagttctagtggtatgcacatatggccaacataatggaggatgtttgctaatgatggtaattagtataacactgctttaagaaaaagtgtcaacagattagcatgatatgccacaagcaaactggaccaagattatcacttttatttttgctttctaatttcagcggttaaattttaagatatttgatatagcttaggagattgattgctttgaaaaccaacttaaatatgaaataaagaaactatactagcacaagtaatgcaagaaataaacatcacttcaaggtcaatatcaagaaattggaaccctttctgaatttataagaatattttgagaaacaactttcctgtcaaatggaagtcaggagaaaatcaacaaagagtcacctttgtacccaagaaaacctatagacacatgtaacagcatgcagaaatataaaggtaaaaaaatcactcaagagtcagtgagaattttttttagtaaaggtcatttgatgtccacttccttgtatatcaaatagttaaatgcggatgaaagcaggagatatgaataatactagaccgtgtatccattaaggaatcatgaaaacaaaagtttaaagcaagaattgctaaaaccaagtgttttctcaaaagagctcttaagtcaaatgtagaggtaagaatatatgactttatcactgtatcattttattacaggatggaattcaacattttcaatgtgattttcatgtattttattgatttgggaaggttagcgattaaatattgttaataacattctacctggtttctcaacatctcatatcttttttcctctgacccatcagaaatactactggcacacttgtctccccagtgcacttcttggattgtttttgctcctctgctcaccacacttcttgaggctgcttcctgaattcctccatacatatgaattctttagcaggctattcagcatgcctgtgctgtctgtgccaaatctaacttccagtcattttcctttgcacttgtgtttggctacttaggtttatcttaatatgctctatatgccagggctcttcagagaagcagaaccaatgggattgtgtgtgtgtttgtgtgtgtgtgtgtgtgtgtgtgtgtgtgtgtgtgtatctccaggaaacttcagtttttacatttaaggctttcagctgattggatgaagatcacccacattaaggagaataatctcctttacttaagctgaattgattatagatgttaatcctatcaacaaaatactttcaaagcaatatcaagactagtgtttgaccaaacaactgggccccagagcctagccaaggtgacgcataaaatttaaccatcacaattgccttgcttttctttctctatcgtctggattttaaaattttttatactttaccttatatgtccttattccatattcctaaatttgaatacccttcaagccccagctcatttctctcttattttcaaagtcattaccattcacttcatcctggaatggtagctaggacctgtgaaattctgtagcaggatgcactgctttcatagcatgcatttcatgctgcctggtgttgaaggtatttgtgtaaggcttttatactctgtgagagctttgagcttctcaagggccagagctgtaacacatatgtctttgaattaatatataattcattgctctacacaaaggtacatacttttttttttgttttctgaagtgcagagtgctattctaagccatcttaaactcaaagaattatagaaacgttctggcatacagtcagaatatggaataggaagagtgtttcacaaagtgtgataggcatcctaccacacaaagtagtgtttgctttaatagattcatgttcatgttactgtgatttagaaaaaaaaaattgtaacatcaaaccaatgaattctcagatattaatgtttaggatggtgttaaaacagagacttatgttaggcttgaatcaatgattaaatatttatttgagggtcaatgttcaagtatgacaatgtagtaaaatagtatgtgaagaaactaggtttgttccatgttaacttaatgcagttctagactggaaatgaggagaattgaaattctataggcccatcactcattgtgtgtgtgatcttaagacatttttacctcttggcatctgtatcttttttggggggtaggtattctgttatcatctaactctaaaagtgtaatttgctactaagatgcctataaatacagccagactacaacacagatggtgcacacaggaagaaaatctctgattggtagactaacccaaaataggctgtgtatatattgaatgaaatacgaccaaaaaatctgcaaatagcagacacagagcatcctttaggttggaactgagtaaagtagatttatgatctaatcttacttattctatgacatttctgtttaatgaatgtccctgatcctcctgccatcttactcacatttctaatgtgctcatactccgaggtaataatgatcatttgcaattataaatgtcctgttatcaattaatttgcagttcaccagtaaccatctgattatctctaacaaagctgcgctggtgtggtaattatgttgagagtaatcatcatgtaattgcacataattatttgtaccttattaagtgctcatatgattaaaatatttctggtcaaataaaaattatccgtgagagtattttttggaggggggaaataagaaatgttgcttcctggtcttctgttctttgaataaggtaaagctgtctagctgacagtccataatgccccagataggatgaattagtaaggagagaagagacttagatttcattaatacaataccttgtacctccaatgaagttgagataataaacttcaacttccagcatggatgaacgctttccctgtagtagctataacaaaaaatattaccctattaagagtgtacactatgaatgtcattgaggacaatgtgtttttcatgtccaacaccgccattagcaattttatactgaacttttatttttctcatagtactctctcttcaaaacttttaatattcacttatttacactcagtgttttttttaatttccagggactgtgtttagtgagatgatctacaggtataattccaaaagcacctaccaaatttgtttattcagacattcattaaagagcaactctatatactagcactctcctttagaaatattatgtgagctacgtagccaaatttactttttccaggacccacaaacaacagcaagaaataggtaaaattaatattagtaatatattttatgtaaaataatcattacttcataggtactcagttgtaaaaaagattagtgaaatattttacattttttgtactaagccttataaatctagtgtagattttacttatagcacatctcaattcagatgagcaacatttcaagggctccatagccataggtagcttatggctgctgaattagatggtgcatatatgttgattgtatctacatggtagataaaggagagtcctaattaatagttagctctctgattttatagatgtttttatgagtttcaatttcctaatctggtaaataatacatctagcctaaaacatttctttttaaattaaaatgttttctagaaggatagggatggaactaacattaagggactgctttactaggtcatgtaggatactaggtatatttacatttattatcaaattcattcttcacaatagtctagaagggtatgttactttacaggttagaaaagtgagatgtaaagtttaaccttatcaatagtagaatagtagaactgggattcaaacttggctatcatctttgaccacagattttgtctcatgcttttcaaataagaaacacatattttgggtccacttgctcattgataggtctagtaagaggattttacttccctgaatactgtgtaaaaggcttgactgcaagaaagttactgattagtttgatttttagggtttctcctgaccttccttatccatgtttcccagtccagtttcttgaattagtctctcctgaaagcttgttctttccagcaaacttatctcaagtatagcataaatcatcttccactggcattttaactgaaagtctgttgactatcacgcacacttacagaaagcctacctttggggataactgagtgactgacagcgatgccttagcaaccatctgattgtagttacagaggaaatttaccttggattgaagaatcacatgccattgtgattgacagagtctgtaagacaatcaaggtcaaacccagagtaaattgagtatgtggctatgagcattgacagataagtcatgtgtcaaatattgcctagccatctggttgctactcatgattagactggattcattgtgtttaatttcttattgaggacaactacatgggaaacttgtttgtttttagtttatcagtgaaatgtgctttatctgctgacataaaatgtttctgcctaaagtgaacttgcaaaatcattagttttatgactccagcatgacctacaaaaaattattatttaaaagtgattgatgcattattgaaaaaaatatattaggtgctgaaagttacactcatgaataaaagcacaattccttaaagaggaataagaaaacaaatgtgatcaccccgagggtttttagaagcccccaaatgtttaaagactattagccaaactgggtaccagatatgtgggtagtgagaggtgatgagatgtcagtgataagtgatgtataaggggacaggtgccttgtgtgaaattctgaaaattcacatttagtagaacgtatcaaacgccagtagaacgtatcaaacgccagcaaatacttagtttatttttgaggacaaaagtggaaaacacagggaagtgaaatcaattgtcctatgtcacattgtacttggaatggggctctgagtcccctgactactaatccagtgcaatttcctcctgtaactttgctgcctttgtaaatgattacattttaaatacaagggctgtttggcttattaattagttagtgttaaaaaaagccaaagttgcttttcatcactgatggattagtacctttcattctgttttcaactaccatattgtccttttaactgaactattaaaaacatttttccttgttgatcacagcttgggtgaacaaagtaggggctaatgaaaataaattcccggtcagagaaaatggcagttgcacgagttttggtggtatgatagtcacatttgcatatgtaaagtataacactacataagcaaataatatgacccaattttaggtggtgatctatatgtcattgctggttcctctgcaagaataaatactgaatgcttctaggcatttccagtaagcacagtaaatccatttcaataatgaagaattcctgagaaaacaatataatagaatcaacaggttctagcaaagtggaattttatcataaattacaagttccaccatgttaacacgtacattgcaacatgttttggacagtacttctgaggttggaattctcagcaagtggttcctattttgacatccagacagtgatagccatttgtaggtggaaaattagttatcagctgtgccttgctttttctttacttgggtttctctatttctctgtctttttacacacacacacatacacacaccccacacacatatacacatatatatctatccttggatatccaaaaaaagattctcaataaattcacaacactaattgaattgagatgatataaagttgttgattatttttaataaagtctagagatctaacattagttgtagcttatttcttcactactaaataagaaattccaagttaagtcttttcatcttttcattaataaatagccaatatgtaatatctgcccatccatatatattatgaactatctgaactactccttataattatggggtaaccagtcaaataaaagtgttgaataaacagcttattgtatatgttatgaattacctgacttaaaattaggagtcaattagtcaaaatgccatgggctatatgactcattgtaacattaataaagtaaaatatgtcttcctataatccagttattggtattaaataatattgaagctattttccaagcaaaacttccgcataagtttgtttttgtcttggttgagaactggttcttttgagataaagccaccaactcagcacaggtttttttttttttctcctgaatggttttgttcaacttaaaatgactgttcctaacagcaggtgctctcttctttgtttcagattatattgaacatgcttttggtcttcacaaatactgaaaatcaactataaaaatgctggatgaaaagaactatatccatatggtaggaagataaaattttagctctaactcatatcttctctgaagaagattcttcagtaagttcaataactaacattatacattcagtcttttaggaaatccttggatctattttcaaaatatatccagaaacagaaagcagctataacatttgactggatctctcattatgagtaaaataaaatctttaacagctattaatcttatacatgatatgacagccgtgattttacctttcttttttaaaattaattttaacagctttggagatccttcactgagatatccagtgggttcaactgacaaagcaaggcacaatttatcatgtaggaatgtacttcacgggaaattttcttctacatatgttttctcttggttcccagagatgaatccgtaataacaataggattctgctaactttgtttttctgattccagttttcctctttactaattccatggctctttttttggggctcattttttgcccaataaattattcccgcttattgacaggactgatttgggaatttaaggtctgaccatttggtgatatctataagtagattcattgtttatagagacctgttctctgttaggcgagagacaatagagaatctagttgttagtctttatctgtttgtttgcttgccaacactgacctcaaataaattaagaattttgtggccactgggcaagagaacagctctttgatatctggactgtatataactggaataatggttatgcacccaaagccatacatggaatgtcatatttgagaatgatagtcacataaccaccccaagctactaagatgccataagtctttaccccaaatgtgtcagaaatggaagacacttctctcctattagaagaaacaaatacgtttggaaaaaaatatttttggataggataacagagaatatcctctccagagaacagggtagtgaaatatattttgttcacataaactgaattttttttttctttttttgagacgtggtctcgctctgtcacccaggctagagtgcagcggcgtgatcatggcttactgcagcctcagtctcctgggctcaagagatcctcctgcctcagcttcctgagtagctgggaccactatcacacaccatcacacgtggctaatttttatgttatttttattattattttggtagaaacgaggtttcaccatattgcccaggctggtttcaaatgcctaggctcaagtaatccaccagctttggcctcccaagggttggaattttacaggagtgagccaccacaccagcctgaaattttcattaaaaggaacttcccttccaggaagggatgaaggaggacttttagaacactagaaatgacagcccaaagagacagagcccagagcatgggtgagggtgagctgtggtgtcttgaaacctagacacttgttggtggaaccagcttgggaacacaggctaattgggaagtatggaaggaggatgcttcagacacaattgaatttttcagtgttactaggacatctattcctgtgtatgaaccacccgcctgctgtggtttgaatgtttgtgtcccctccaaaactcatgttgacatttattctcaggtgaaacaatattatgagggagggcccttaggaggtgataaagtgccttataaaagggcttgatggggcgagttacccctccatcccttcatgtaaggacacaacctcatcccctctggaggatgcagcaacagggcaccatcttggacacagagagctgccttcactagacactgaacctgctggcaccttggtcttggacttcccagcctccagaagtgtgagaaaaaaatttccatgtttacaaattactcagtctgtgttatttggttataacagcacaaatggacaaagatactggcccttctgcaaaaattcaggtcctcaaaatctttgtgaaggatgtggcttttgttactttgctttgcttaagaagggagagtggtctacaatcacagggttgtttacctgcaagctcctcctgggcctggattcctcattgtgcaactgttgtgttatcttcagtgtccacaccactcaaagacaactttggtttgaatggagcctggcctgggctttttacagaggctgacattgatttggcattctgcagggcaccttgctgacttttgttttctctcttgggatgtatccactgagacaaatgactcatccattctctgaatttagttttctgaggagtctgtcttctttggggcagaaatggggacacattgctcaccacggtctctctcttcctctgacctttgcaggaaagtgctttccctctagtgtgtaaagtccccaaccctatgtccaaattctggattctttactaattggaaactgctattataggattcccatttttttcacttggctctaaattagtatcccagatctttcaggagggtctgaaacttaggggattcgagctcttgctaccccagggcactttccatatgctctaagtggatctataaaacatgggaaggtgccatatccccacagtgtatgctatggggatgaggctgtgagccattagcaaattttctgggtcagtgggcacttcagttgtacaatcatgagcccggctctcagtctgtgcctctgtttagagttttaactaagaagaaagatggtcttcggggtgtgatttccagagatcttggactgccaataatggtacaaagtatttcttggttattacagcccttagactactcaaattgtcattgaatatttgggagattctaagctaattagttctctgtgtgcttaatttattttctggttttgttttatgaggcatgtgggactccatagccttaattataacatatccttggaaccattggtcttttcttttttaactgtttttttctttttttaattttttattattatactttaagttctagggtacatgtgcacaacgtgcaggtttattacatatgtatacatgagccatgttgctgtgctgcacccattaactcgtcatttacgttaggtatgtcttctaatgctatccctcccccttccccccaccccacaacaggccccagtgtgtgacgttccccttcctgtgtccaagtgttctcattgttcaattcccacctatgagtgagaacatgcagtgtttggttttttgtccttgcgatggtttgctgagaatgatggtttccagcttcatccatctccctacaaaggacatgaactcatccttttttatggctgcatagtatttcatggtgtatatgtgccacattttcttaatccagtctatcattgatggacatttgggttggttccaagtctttgctattgtgaatagtgccgcaataaacatacgtgtgcatgtgtgtttatagcagcatgatttatattcctttgagtatatacccattaatgggatggctgggtcaaatggtatttctagttctagatccttgaggaattgccacactgtcttccacaatggttgaactagtttacagtcccaccagcagtgtaaaagtgttcctatttctccacatcctctccagcacctgttgtttcctgactttttaatgatggccattctaactggtgtgagatggtatctcattgtggttttgatttgcatttctctgatggtcagtgatgatgagcattttttcatgtgtctgttggctgcataaatgtcttcttctgagaagtgtctgttcatatcctttgcccactttttgatggggttgtttttttcttataagtttgtttaagttctttgtagattctggatattagcctttgtcagatgagtagattgcaaaatttttctcccattctgtaggttgcctgttcactctgatggtgatttcttttgctttgcagaagctctttagtttaattagatctcatttgtcaattttggcttttgttgcaattgcttttggtgttttagacatgaagtccttgcccatgcctatgtcctgaatggtattgcctaggttttcttctaaggttttttatggttttaggtctaacatttaagtctttaatccatcttgaataaatttttgtataaggtgtaaggaagggatccactttcagctttctacatatggctagcctgttttcccagcaccatttattaaatagggaatcctttccgcatttcttgttttagtcatgtttgtcaaagatcagatggttgtagatgtgtggtattatttctgagggctctgttcggttccattgatctatatctctgttttagtaccagtaccatgctgttttggttactatatccttgtagtattgtttgaagtcaggtagcatgatgcctccagctttgttcttttggcttaggattgtcttggcaatgcgggctcttttttgggaatcattggtccttgaaggcagctctaatttcacctcatagctctgctctctgaagcacgcctctgctatggctggagtcccttgggggcgtgattcccattcttattcctaggttcacgatcagctgttgtgtaacttatagttagctctgggttgcccttttggcccccattttagtcacattctgccgggttccgtcttagttgtagtgtgtgtgaggacacaatatcgactacatgcagagatgtatttaccgtctgccctaacctgatgagtctatgcagggcccttgcaaatatcaaagcaggaccaccttatgccgctagccttgcttactcacaggagaggactagatgccacatttttctcccatgattatctgttttctctcagctcagattttgagtctgcctctgaaacatgggtttctgagtagggaaaggtggcatggtaaaaaggccaggattgagatgttctcttttgacaccatagttttatggattcaaggaccatgagaagtgcatcctacttctgccacttgtgaaagcaaatcaagtgggttttaagatgacagcaagaatgaaaagggagaaaaaaaaagtgggtttgctatacttgtcaagtgcctggatcaaggaaggatcaaggaggctttctgagccccttgattggttaccttttgagcccttccccaatcattccctaggcagaattttctgcatcttctaagtagaattttcctgggtgcttcagtacaatccacttgagatccttgttcctctggcccttcaacatggaagtccatgagagtccatatttgcctttccattgagaggtccctaataatttatctttaggctgcatcagcaagagtccctaggattctgtaggcctggcccctctcttgttctgtgagtccatgttgaaggccgtgtccaagttgcttcctcatctccttgctgaaaacaaatgcttcaggaaagatagagactaggacttaggatgaaaaggtcaagttctcctgaggaagattgggagctggagggatggaggcttccaaagatctctgggcctcagtgggtaaataaagtccagaaaccttttagctatttctgctgcagtgccatttcaggcatagaatttcaggtagggtgagaaactgtacccatttctgggttctagggagggatactctataggcattaatctgagggagagagggttgaaatctggcctctcaggtacctgtgaaccagacagaaaggcagtaattagggcaaagttgcaggaagatgctggtgctgggccttggggtgggaaacaggttgcagctgaggaagcagtaggaattctttagcctgcattagtatttggatggcaatgggctttacattgaataaacaaagggagactctgttggggaacagctaccacagactaagactatcagctacaaagactccctgtgccctcccaggagagttaactttacttacactgcaaatcatgccccaagttcttgagagttgggagatgctatgtacactgcagctgctctggttgcccttcagtgctctagagggactgaggattttgccctgttcatcattaagtaattctgtggaattcagaaaattcagcccataacctgacctgagatgttttggaaatgacctttccttctttttttattttctgaaatctgaaaatccagtttctttatgactcatatcttcaaatgcttattgacatccaggctaaaaaagaaaaagttgccagcttccacatgcagggtgtgcccaggcaggggtctgtgatgtgtgaagagaaaaatgctcttgatgtaaaacacaatgtgaggaggtagggaggaacaagtccttcaccgatgcctgccgctagaaggctgacctggaagttggggtccatgcctgagtaccttcaaacagaagaggctaaccagctgaagaactcagcagatctctctgggatggtactcagtgcaataacaggcacaacagattgagttaacgtggtatatggtagtgctggaatagagagggtcagtgttgtaggatgtcagataaatgaatcagtttgatccatggaatgggctgaaggttgagagagattgataccctgagagaggagtcagccaaggccatattcttctcgcctccatgttgtccctgaaaaacaaaaaaagaatgaggggctggagccccattctgactttcctctctctaagc

SEQ ID NO: 299 - DNA, 299839 bp, Homo sapiens
actccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaa

SEQ ID NO: 300 - DNA, 283308 bp, Homo sapiens
atatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaa

SEQ ID NO: 301 - DNA, 146655 bp, Homo sapiens
cttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaa

SEQ ID NO: 302 - DNA, 397906 bp, Homo sapiens
aaagttcaaatcatttgagtaagagtttataaggacacaagtcaacctgaactaaatacatacatacttctgcacaaatgttgtttaccgtatgttgggtaatttggaggaaggtaaagtgattagggtctcaaaattttgtccaaagccttgctttcaagttctctaaaattggagccaatgatgcctcttgtatctgaggcaggcttaggagtctagtcccttctctcacccacacagggagaacacaggcagctcagaaacatttattattaattttttcagtcacagttttcatcttgagaaagtggcaccctcgggagagcgctgggaatgttcagagcctgaatatcatccactctccaagtcccagaaagaactcaacaaagtctcagtcctaatgaagcccaaaccaagtgacctcttagctgggaggctttgtgcattttaaaaaagactatgtaagcttgtttcccagaagctctttctgtctgaccccatctgtcatcccatctttttccctgatctgttgcataatagctgagggaaagttgtgttagagtgtccctccatcgctaggccagctcaactcaatggcgttagtatcctgttcaacacactccattctgtaaagggccatataaaaatgtggcctgtcagattcacaaaagtggtagttgattttattagactagtagttttaaggctagtagtttagccatttaaaatctatttcccaaaagaggggaaaactagtatttttcttctctttttaaaaattcattagccagttgctatcaaaaagcaaccttttgggttggtgaaggcaagagagttcttaaattactccactatgtagttatggccttcagcctaaggagataaggtacatttattgtgctgtctctcatcattggaaattttacaacataccatatacttaaaactagtaggcagacagaatttaaaagactcattttcgcagtatgcattctttccccattcttgcagagtaaaggggtaaagaaaaaaggtaaaaacctgaaaacccaccataacacagcttaatcgttaagagcacacaatatttgtttctatccctaattccgaagggcacatggtccatctttgtccacagacaaggcagcattcttggggatctcctggaaattcctgccacctttttctctccttctcaaccaggctgcaacattgaaagatggactgtactgggaggggcggagggagaggaaaaagggaaagcgatatgttcaaccaagccttctgattctgcctctagactggcataagtccacatgagttatgttcttttaaattagaaataacgccatgaagataagtgccaagtgctcttctgttaccagttcatcatggaatttctgttgagggtcatgaaaaacacttggctacttcctccagatcgcacggatgcaaaaaatacctgtttgaaattaaaaagaagttagttcaactgcatggtcttttcccctcttttcttcaaccgtccatccattttctctcacatgtcctatccttgccatgtgtcaggtcttaagactcaatggcttgtgtttataaagtccctttggatatcgtgcatcctatgtaaaaactcctgcctttattcctaggttgttattattccttattgtggtattggtctccagagatgctgaaggggctatatcttcatttgtaacatctctttgggtgttcactttttaaaagggagtttcatgctaggataacgtgctggatttctggtctaggacccaacaggttctttgttaatttctagaaaggcacagaagcttcccttctctcacccttaaatgacaagaaagtagacttcaggatggaagggaatcccttcaaattctcaaagtcaagggggagttttaggcctactgactatcatacagtttcagatttcagttttttaaatttaagataaaaacattaaatagtgtggtcagatagggcaaggtatttaatgcctactcattttggcatttcaagagttaacgcatggtttctctgctgatggtggcatatcccagggcaaatgagatcatagcattaatgaggagaaccacagtccattaggtctgagtctgttaagtcattttatcaaacaactgacaaacgtgagaaaaatttgggttactgcttgcttgagctgaatgtttaatgttaaagaaccactgccccaggaaagtaatattttgggctatggcctagcccttcagtcagtcaatacctaacttttgttaggtagttgcttttgtcactagtctaaagtctctgctacttcatttctacagcttcttcagaagaatgctaacaacaacttcttagggaggtctctggaaatgcttgacattcacctaatgctgcatatgaaagtaatgctactcttagggtcaatgaatcaaaacggagaaggacagagagggcctatggaaaaccacaatgaagaaaagaaagggctgctcttccctccaagttgtgtgcccctggctgtaaaccttgggttgcagacaactggtgtggccccagcctactcctaagggtgtggcatggcttggaacagccctgctggggtaggttttcaatcggaatgtgggtatccatacccagatcactcctggttttttgattcttagagactgggtgggagctggagttttactaggttatgtttgttttctgggaaatctaaatggctggaaccatctttgccacctgcagctactgtccacccagaccacatcaggtcagagtagtgggccagggttgaatatagtttaggcccacatcaccaggtttggactaagaccaacctgacctttggggaactggggtggacaaagggatatacaaaaattcaacccatcatactgtttttctataggcgtttatgtctgtggctttggggacagcatttctatgttggccacagccacaaaggatgaattcacaaatgcagtatggcttagctactaaaacctcggggttactctacagggagggtaagggagaagcagtactgctgcagaatacccctctgaggtcactgatcatgccagacggacacagccaatttcactggaaaacagttcacctatgacatttcagaagaaacatggctggaatgacacaagacatggcactagttgagtttgtgattgtgcattccttaaggaatgggtgacatttttaaaaagcttatatttctaaacgtcaaatgttttggatttaaaggtgaatataaggtgattggttaggtcttgaaagtgactttgtgaaaagtctaaaagtggaagtataaagttgacccactgtgagatgattaatgatgggccaactgctctaagtgcttaggagaatttggggtgtctgctgagtcatcaaaaggcctttaggccacaaaggtttctaagaggtttacaagaaatttctaaatgtttttatgtagtttttgacatgtgaataatatattgagtgctcacatggatcaaaccaaataatgccatttcaagataatattgattgtttaacacagatgtgattcaaatcagtataaaggaaaatgaaggtttcacaggtacctggtggtctcttaaaatgcaaacactaatgcaaatgttgaaacggatttaccttatcatttctttcacatagaaactttaacctttgagctcgcttatgcataaatactccatccaaatgtcctgtttccactgaccggatctcaatagctttctcgccccagcccattatctgattggaatgaatgtaggctgtcaaaaggaatttccaaaactgcattaaaaacattagatgggcaataactcacagcatctgttcacatcttaaccacaaaaatgacaaacgacttgagataaatggacaaagcaagtcttacaagagttattcacagatttttttttttttttttttgtggaatcaaatggttgtttcacatttcttgattttcgtttcatttggggggtgtaactgctgaaggagataaggaatggttaacctacccacagacgtgggcatttctccccattggagcaccacatccttagttatccggccataggtgtttacatacaccccctcatcctcatagcaaacaagcatttccattccatctgttttaggcaagatgacaatagcatgaggagtgatattgccctgaatctagaagacaaagaaaagccaagcattattcttttaaaaaataaaacaccttgactattcatctctaacaactgcaaaaaagaggtttttgtttattttcattgtcaccctaaagactgaaatttgctttaatttaaccactgacttgtaaaataccctggtaaatcaaacttagtcactagattaaaaattcaatttacctgttcctaaaaagagcatgtaaatctatggcacacctactatgtgccagtcatggggccctttacatatataatttctagtacctacaatagctccccaaggtagatagctttgtttacagatgaggaaactgcatctcagaagggctttgtgtcttaaccaaagttgtgctagtatttgttggtagagttgggatttgtgtatatcttgctgacgttgaaattaatgtgttttctattagcacaaccacttccaaaagaagatgaggagaatgtaagccagctgaatctaatggagatagcttaagtggggtcaaaatgaactaccaaaataatctgtgaaaaaaaaatatatatataggattgtttatccgggtgtctaaatgccagaataattcatggcttggttagaaaaaatatttagaatgaccactcattaaaaaaaatcattattgccgcacacagtggctcatgcctgtaatcccagcactttgggaggccgaggcgggcggatcacgacgtcaggagatcgagaccatcctggctaacacgatgaaaccccgtctctactaaaaatacaaaaaattagccgggcatgatggtgggcacctgtagtcccagctactcgggaggctgaggcaggagaatggtgtgaacccaggagaggcggagcttgcagtgagccgagatcacgccactgtactccagcttgggtgacagagcgagactccgtatccaaaaaaaaaaaaaaaaaaatcactattgaaataagtgtatattaatttgttctaggaaaggaaatgtgatgttgttgtgatcccctagttgagaatgccatggcagcccaacatgtgcttgacagattggactaagagagttgaggattatcatagttacaccttagctgcctcaccaggaatgtgagctgtgagtccttgtgttcacccacatccacatgagttaaaagtggtaataatgcagcaatgaatggcagtcgtgtgtgtgtatgtaatatactgaaacaacttcttttagttattgcgtttcattagaataaagtcttaaaactctcaaaataccagtcagcggtagcttcaaacattcctgataaatagtttctcctgtgtgttagtcttgggattacacacaggacacacactttacactacacttaatcctaataagtgaatccatgtgcagcatttccctttaacagttatgtttcaagcaatatgtcaggatagtaatatgaatattttagggctaataagaagatctacaatttgcagggccctgtaccaactgctttagatccattacctcatttaatactaatgataatcctatgggataagtctttttatccatattttacagatgcgaaagctgaggattggagaggctgcctactgtgtccattactgcaaagctaatacatgctagagccactgtgtctgactccagtgtaccacactgccctcaagctgaagagaggaactaaaaatagcaaaaaaagaattttctccaataaattagtacctgaccattggctttctctaacataaaatgaacgaatttcccttcaaaaactgaatgtggaaacttgtctaccgaatataattcatgcccttgaaagaaatatgtcatattcattttaatctaaagtccaaagagacaacatgtaaatgccaaatgatttctattatgtattccccaattttaggaagtcataaaaattagttaaatttatatattttagttattaaaagcagtatacttaatgaagaacgaaagtccatttgctggttagtaaagtgtgcatgacttctactaaaactatgcaaaacaaatctctttctacatgcaggctgttgtacagagagcccttgaaagtctacttctgagtacttacatgagatggtatgtagatatcataagagtttcctgaatcaacatcaattacatggaaaccagtgtgtgaaccaaaaataacctttaatctttgaccttcttctaccgtgagatcaactagcagaggcttgtgctggagatctgcaaaagactttaaaaatcaccccattagtatccgcatcactcaaagaggcatcttaatttttttcctttagccactgtctagaggaagttaacttctaactttattaaagtgaaaaactagaaaatttctctttcagttttaggtctgttgatattctggccctaggaggaagggtctagcatccatttgtgcccctttctctaccctttgtccttcggggcagtgaagtttaagttggtgcacaggtgtaaattttgatagtggtaatgtatattaaaaacctggtgcctgggtattgctgttttttcctgtttatttctggcctttgtcctctgaagaaggcccagtcacctctctggcccccctctttcccatgtggcaaccaggcccatccacagcaactaccctttcagagacagcctgggagggacagccaaggccggctgttttctcagcctgtttagtattaatgggcatgctctggtttggatttttcttcagtgaatgagtaggcataagattggcactttctcttaatgttggaatctgagacttgggtttgggtggtagagaaagaggtgggagtggaacatcacaagattgatggcttgcattgactatttgggtttaactagaaagcaaaaagagagatcttgccaagtttgtcaaagttctctgtgtttgaatccagagcccaagccccaactaactgtcaagtgttcctctgccattttcctttgctattttttaaccacgctctacctttgggccttgagatctgggagagcatttgtgaaactacaattgccttaactataatgccactgctacctctcagacccttctcttctcatcttttgctaacaccattctgacagcatgggaagctctagcgtcctgtccttgtcctatgggaaggcttggcctcttgccagttccactctttcctgttcaagtctttgcctttgctcttccctctttctgggctggatagggtctgtcagaaagaacattttgcactctctcatgtgtctctgggtcataaaataatggcaataacttcagagcaagaatgggaatgggatgttgattgaaaagcttttgtggagatagattttggcagaacaggagtaccactttggcttttaggagttatcccttgttattagtaacctaatgcattccaatttttttccataaaagtgaggtcatggaggggagcccatttccattaatgaatctattttcttgagcacatcagaagccatctgccctaagggaacaagatagaagtgattcagctctgaagtgggcctacatggtgttccaagggcagttttgcccttcatgagaatgtggcagaaaataataaggagccaaatggagataacagtcataaaggtggggagaaaaagtgagagccaatgagacataaagaagtagacagacataagctgagagagagagagacagagagagatcagagagagagagtgagagaaaacagaagataagttcacttgggctatggataggttatgcggctctgaacacatctgggtgcctgtaagtactggtcctcctggtattcgggtgtcagcttcatgagctggggtcaacaggactagcatatccccatcccactcctggcaaatctcatgagtgaccaatccaaccatggtgggtacagacttagacaaggtaaaaaaatgaaaaggcaatcaaaatagaagaatgcagagaaactaggtcatttctgtaagttagcactggggacatataagcatcacctgagttttagggacttcattcagaaagatttatgaggattaaaagagactcagtttaactctgagattcagtgctgccatttgtctgcctttttcaaacaaaatatcagggaataccctggtttaggtggctttataacaaatgtcattgcataagatcataatcaatgctatgcctactaaccattctaaatgcctcttgaggatgatgattcatagatctcaaggaggagggcatacccaaattttaatctaattttatagcatttacaaatattcagtctttacttttgaaacaataaaccctagagtacctacacttttaaaacaggtttattatctatatgaaaattggtattggtctatatggactattttattaatgggtagaaacggaaaatttttaaaaagcacattttagataatcacatccctgcttaccttaaatgccatgaatttatgatacggtttaggagcccaagcatatatttccacagcattctttaaggcaatcaccaaaaatttgatcctttcatatttaactgtaatagaaaaattatgagtgaaaaagtacatcaatttactcaagttctttgtattaatattaatgaatgtataagcaacaatatgtaaatttaaatattgatgttgggtgtcagcttcatgaaggtgatattcctggtgtgggattttttcatagatactgatttagcttcccttagcgaactttggttggcagaatacttatggcttttgctttatattgaagacttttcatcatccagagatataactgcttaggactgtctttaacactaggtcttgatgttgatattcattgtaataagaatgtgcataatttccttcatgttagcttgcctggcttttacgttcacccatatttaagtagctgagagcagatatggcaagatggtagaaaaattagcaaatgggcagatataaaggctgccatttgcttattatttatatttgaattccaattaccaagtgaaataattgcttatttatgcttctaacgaaaggggggtgttaggagtcttgggttctgttagtggcttaaagggctacgaatactgacaaatccttttactctttagaaagatggaatattaagcattgtaaattctatggacagaagcttagttaaatgattgagtccccacaatgcttttgcctacacaaagtagtactcaataaatgcttattgaatggaaaaatggaagaacagactgttgtctggcattctcttcattactcttacctacgtgtgtgtctctgatagaataataagcaatgtttacggtgatgaccttgagaaattgaacaatcctttaagtgccttctgaatcttttgctgttaagtgtggattctaattcttagagaattcgtaatccacagttggtacacatggcagtcagtttcttggtaaaatatctcaagaaacagaatattctgagtcctaaagaaactaggtaggaaaaattttaatatacttaaatgacattaagtttccagttacttgctttataacttttcatgacataaagtgtttattagactatttttgctgatctcttcatctgaaacctaggaaaagatccacagctcttggcattgaaggaacatacctcaaaataataagagccatatatgacaaacccagagccaacatcatactgaatgggaaaaagctaagagcattccccctaagaactggaacaagacaagaatttccactcttaccactcctatagtattggaagtcctagccagaacagtcaggcaagataaaaaaataaaaagcatccaaattggaaaagaggaagtgaaattatctctgctgatgacaggatcttatgcctagaaaaccctaaagattcctccaaaagactcttagtgctgataacttcagtaaagtttcaggacacaaaattaatgcacaaaaatcagttacatcaataatgctcaagctgagaatcaaatcaagagctcaatcccatttataataacagacacacacacacaccccacacacacccctaggataatacatttaaccaagaaggtgaaagacccctacaaggagaactacaaagcactgatgaagaaaccacagatgacacaaatgaatggaaaaacatcccgtgctcatggataggaagaatcaatattgttaaagtgactatactgccaaaagcagtctacaaattgccaatgttgttttttacagaattagaaaagacaattctaaaattcatatggaaccaaaaaagagcccaaatagccaaagcaatcctaagctaaaagaacaaagttgaaggtatcacattacctgacatcaaactatactgtaagactgtaataaccaaagaagcatgttactgatacaaaaatagacatacagatcaatggaacagaatagagaacccagaaataaagccacatacctacaaccaactgatcttcaacaaagtcaacaaacataaacaatgaggaaaggacaccctgggaaaattggctagccatatgcagaagaatgaaactagatccttatctcttaccatatacaaaaattaactcacgatggattaaagatttaaatgtacccaaaactataataagaaaacctaggaaaaactcttctggatattggcctagacaacatgtttatgactaacacctcaaaagcaaatgcaacaaaaacaaaaaaagacaaatgggacttaattaataagctaatgagcttctgtgtggcaaaataaacaatcaacagagtaaggagacaacctacatgatgggagaaaatatttgcaaactatgcatccaacaaatttctacaaggaatgcaaacaattcaacaagaaaaaatcctattaaaaagtgggcaaaggacatgaacacacatttctcaaaagaggacatataagcagccaaccaacagatgaacaaatgctcaatatcactgaacatcagagaaatgtaaatcaaaaccacaatgagatgccatctcacaccagtcagaatggctaatactaaaaggtcaaaaaaaaaaaaaaaagatggtggtgaggctgcagagaaaagggaatgcttatacactgttggtaggaatgtaagttagttcagtctccttgggaaacagtatggagatttctcaaagaactaaaaatagaactaccattctacctagcagtcccacttctgggtaaatcccaaaggaaaataacttttttttttttttttaaatcaaaagggcacctgcatttgtacatttattgcagcactgttcacaacagcaaggtcatggtatcaagttgtccatcaatggttgattagataaagaaactgttgtatatatacagcatggaatactatgcagccataaaaagaatgaaatcgtgcccttggcagcaacgtggatggagctgtaggccaatctcctagggtaaaataacccagaaacagaaagtcaacacatgttctcacttataagtggaagctaacaatggggtgcacatggacacaaagctggaaataatagacactgaggactctaaaaggggagtggcaggttaagggctgaaaatttacctgttgcgtataatgttcgcaatttggctgatgagttcactggaagcccaagcctcaccattatgcaatatacccatgaaacaaacctgcatatgtaccccctggatctaaaataaattttaaaaagaaaagaaaaaaaaatcccttcagattttgctgattttcagggtgaaagaagaaataaataagtttatatttttaaagaaatttaaaatcatcttgaaaataaaaacttatctaagcacatataggctcagataaatcaagaaatattttaaatgactcttggatatacaatttgcttttcttttttattctcattttatatttttaaaatttcacaagaatttgaacatactagaatactcgtgctacaagaagatgtcagtgctgttgtggctggaatttcataggggaagctaagtggaaactacaagtggttctttggataactaaggcaaacagtgtttctgaaaattaagctggtctcaagttttctgatagagaattaccagatattgctccctggttaaattttactttagatgtgtggatatagatcagcctactgatgttaggacaatgaagggacggcaatgattagaaggaagacgtcagaaatgttagaagggccaacagtagatgtgcaggtcaaataggattcctgtagcctgatgtttttgaaaaacacttgtcaggtatatgcaagagataatattcagaaattttgcattatttcctgcaatgaattttattgctctgtaatcatacagtattagtttatggacacaaaatttgatcactagaaatctttggactaacaaatgccaagtaataaaggcaaaatactcaaaaggaaacagctttgaaattgtttctattgctttcccctgaaaacatgacctgttctcaaagaaagcagctcactattttcaaaagaaaaccaaatatgcatatgaatctgaattctatttggtgtgagaatgatgggatgtatgttttatactttgccaaattatcagattgaggacaagaaaaaattagaattccagggtatccctattagaaagtaccaaataattctgattcctgaacaaaaatgtacagtggagcaaatagcttgcactgctgcccagcctgctatagaaaaacattcccgcatgtggtctggtttatgaataaagctatgtcctttgaacatccattcctttttaaaaaaacaaatacttcttaactgatttccctgggcctggctctgtgctaagtgccggtgagatgtagatgtggctctggccacatacgtttacagacattaaacgttttttttttttccaaaagctgctattttttttttttctttgagatggagtctcgtactgttgcccaggctggagtgcagtggcaccatctcggctcactgcaacctccatctcccaggttcaagtgattctcctgcctcagcctcccgagtagctgggattacaggtgcccatcaccatgcctggctaattttttgtatttttagtagagacagggtttcactatgttggccaggctggtctcaaatacctgacctcacgatccacgtgctttggcctcccaaagtgctgggattacaggcgtgagccactgtgcccggcccaaaggctgctttttatacttatcaatacatacattatctatgttgtaagacatagataatgttgtaaggtcaggggctttttttttttcctttgtaaaactgtgagtgacatgttattaagtgaggaacatgtccttctcaggcaccaaaccttcaggttcactagccagccccaacacttcctaatattgtgtcaaggttatctgggaaggtcacctggaatgaaattagagaaaaggcaggtggagactctgcttcaaaatagagtcccctttctagttggcaaaatgtgatacactgaagttctttctttctgagctcttctttatagcatgccccttctgtttccacattctgtatttgatacacttgattagatttcagccgacattatgtcatcacacatgattggacccacttgactggttaaaatttcaaatgtgtctcatacttttctgagaccacatcatggactcctttgaactgaaggtgtctaaagttcctccgccgctcctttattgtcattctttatgttaaataattaatgtattttatctagtacacattttaaaagcctccacacattttcttatcagctatggattgaacaagtcttacaggtacctattttaaaaagccaaagaactctagggcttatgaaaaccaagtacctgcctccctgctgattcctgctccataaaaacaaccgcttgcaactctttcaactacttctttcagcaatttgtttccagatttctaaataacatgattataatgttattccttgatttttttttttcagtcacagacattatttactgactttgtagtatggaaaggatttaatttctcacatcatttccttctctctctagcttcttctctttcttatgcatatgcacacacgatttacttctgtaaactctaaatatagctgtattttaaatttttggttaaatcaatattgagtgttaaaattattattgttcatgactgaggtatgtagtataccatggttacatttcctttcttgttcccccccccctttttttttatacttgttttctatgtatctctctctaagcacatgtaaactttctgctgataaatgcccttcaacatggtcaaacgcagcaggtcatctatttataccattttatttttcttggaggcatctttcctggaaccctgcattgtcccactctgccaggacttatttctttctaggcctgtggcagacttgtcaccccaggttcccttcaccatcattctgggtattttcgtcatcttcctggactactaggtttagttatttattttggtggaacacatccttcagttgcttcctgagaaatggtgcatgaaaagtaaatttttaagacaggagtaaatcatgtgtgataaagtagactgccctccccaatgtgggtgggccttatgcaatcatttggagaccagactagaacaaaaaggctgagtcttcctgcttggttgagctaggacatcagtcttttctggccttcagacttggactgaagcatcagcgtttcttgggtcttgagcctaccagtgctcatagtggaacaacaccatcagctctcctggttctcaggccttcagatttgaactggacttaaaactttggctctcttgggtctgaatgagcttgttgactgaaaatcttgagacttttcagcctgtatagtatagtcatgtgaaataattcctcataatctctctctctacatatgtatatacacatatatatacatatgtatgtgtatatatgtatgtacatacatatatacagctgtatgtatgtatgtatatgtgtatacacatacacacactcacacatatatatatatctccttaacccttaacacaggagggctataaaatactagttggaaataattctgttgggaatttggaaggccttgctgtattgtcttttaagcttctatattgctgctgagacgtcccaggccacacttattctgggtctattgtatgtaaactgtttgttatttatttacttatattctgacagctttgccagttttgaaggccttctcatttcccaggtattgatatatcatgttgatatgtctttttgtgagtctttctttcatttagtatgctggacactcagtgaatcctcttaatatgggatttcaaggcttttaattctagatacctttcttatattctttcttcaatactttcatttcatattctctaaaactcttattacttagattttgaaccacttggactgatctttttattttcttatattttctctgctttgctttttgttctactctttaggagaattccttatcttctaacacttttattacattttttatttctgccaatacattttagtttgcaaaattttttcttggtctctaaatgactttcccctactttgttctacctttttttttaacagcccttttcttgttttatagaaagaagttttctaatctctgtaaagctattatagtttcttgcttccttcctttctttctttttacattttcttccactccttattatccctgtttcttctaacgtcctttctttctgtttgtttaggtttccttcatatttgtgaatttctccactccttggtatagacaggcttatctttagggtagttaggcagcaagcttttttcatggcacttcaaatgttagtacctgtacatcttttctttctggccatttagtttctccaaagacatttcttacattctcttcccagggagtataggcatggctatttgggagctaagtaggggttagagggatgtgtatgtgtgtgtgttttcacaagtattcccagcatcatattggctgtgcaaacctttcatcttctgttgcagcagaggaaggtagtggcctaattactcagaggtggagactgggttctggaagacttgctgctcatgaattttctaacaattctattttcagtcccaccttacacctccacttccacctgagattcccctggggccttagttcctgggcctttccaggttctgttggattgattttgatcattttcctcactgcagattcagaattcagaatttcctggtattctaggtctttttccagtcactcagctactctttcgattttaccgacatttcttctcttctcttggtcccactgtcctcataggcttatggcatttttattcttttcttgtcattttaatgagtctttggaagaaagtagatataaatgttcaaactggagcctaggactttattctgaatgcactctttcaatttcatcaatctggcttttaaaaaatataaataatgctgaaggttccagcaacatctgaagctggtcacacatgcatcatcaatctgatagaaaaaactaggtgaaacctaactaagtaagtctgattgagtaaacagaccaaacttataattccatgtcttgagacttaccaactttataatgtatacagccttccaagtccccaacagtgatccagccttgtttcttttctacttctgggtcattatgtagtattctgtttcttaaccatgaaagatagtaaactcgtagcttattcttctttcctgttgaaataatagaggtttaatttcaaattgctgtgacagctctcactttttccttccccacctccatttatttctaatttattttatttacgtgtgtgtgtgtgtgtatgaaggcataataaccagtgtccccagcactttgtcattaaaatggtgtttctgccagaacttatggttaaaatagctctacgtgttttagacacatcacagaattacaatgtcttttatcttcaggtggtttcttatttgagcatgtgctcttactctctcttcccaatgcaaagcagtgtctgctgaacttagtaagagctaactcttcaacagagtgatcagagttccagaacattctagatcaatcacatgaagaagtgttggcaactgggcattttggcacctgcctttccttcaccgtataacctaataacaaacaagaggataatatgggttcagaaaattatactgggcaggtttatggtgctgaagtcactgaaaggaatactgaacaaaaataggaaaaaaaggatgcaaacttgaaaacttaaatttccgtttggtaaagtgatcttggaataaagaattcataggatgataaaatatttagacaatattgaagagtacacaagtagcaaaacttgatatactccatttgatgatttgcaccagataaaatgtccattgggatgactcttcctaactaatgataaatttagctctatgggttttattttttggatacttatttttctttatcttaggctttaaaaatgttttatttatttatttatttatttttttttgagacatgagtttcacttttgtcgccaaggccggagtccagtggcatgatctcggctcactgcaacctctgcttcctgggttcaagcgattctcctgcctcagcctcccaagtagctaggattacaggtgccgctcccagcatgctcagctaatttttatatttttagtagagatggggtttcaccatgttggccaggctggtctggaattcctgacctcaaatgatccgcccgcctcggcctctcccaaaaaaaatgttttatattttatagatgaatatataccagcagaagagaacttagtaaagcattacacatgcatttgacaggagagcacattcatcacctaaactaagggaatcattgtgtggtcagtattcaattttgtaaccaaaggcctagaatccacattgatcacagtagctaggatggacacgagagccagtgtttcctcctttctatgccaatatgaatccaaggttagttcaagaatcttttgctcctattttcattttctcctttccctatctgtgcctcatgagaaaaggaaactcttacactgttaagaatgaagatgtgccactaacaacataatgaagtctgaatgtgaattttctggttgcattcccacttttggcagatatgcagttttcattttgatttggtagtatagcaatcaggacagcaattaaccagaacaaaagactacatgggattaaactcaaatggcaatacaaaaggaatttacctggttaaccttatttggggagaataaaaagagatgaaactgagcattcagtggaaaggtaaaagaaagaggaagtttagtgacaagcaaaagcattttgtcaaaatggaagtacagctgaactttgaggaaagttcaaaccagcatccctgtgttgtctcttcgtgaaacaatggctgagcataaatccatgttctcaaacttggctgtacaatggaaacacatcagaaactatgaacgctcctgatgcctaaaccccacccccagagattctgactctggtctgggggtgcagcctagattttcacatctccctaggtgattataaagtgcagtagcaagttggttccatactagatggaatgagaggggaagtgacgggtgttactcgttaaactccttcaaataccaaaaagaaaaaaaactttcaacaaaactaccctcttttaggttgcatttttaacttgttacaaggccttcactttagtctccatctttttttttttttcctatataaggctctttttgggaatcagaaagctacagagcatagcagtaatgattcccacactcaaatctttttgtagacttgatcacccagtgtgccagctgcacctgccaaaacatcagtgggctataagcaagagaatttttgagggaagagaccaagaaatttctgcttactaaatgtccctctaggaagcctgcattttgatattctgtctgtatgtggtaataactggagtgcagaaaccttaaaaacatccgaagatccttgctgagtcctgacagaggtaaagagctataaatatatagcctttgtggtatgtctctgcctaattcagatttaatgcagaggtgagagacttctttttggaggtcagaattcccagtgttacaaaatgtgggcaatctcactctggctatactgctatactttattgtgttgtttgttagctgggaagggcagaactaactgtttctgcagaaatgaggtggatccctttcccgctgtatggacctgggggactcatcatcttagtaacatacctgaaattgtcacaaggacattcagtccctctagcacatccatctgctgaaatcgcctccggttgatcagattatagactttgccttgcccacttcggtccaaaagcatcaggccattttcagtccccaccagaaggtttacacctgtaaatttaagaagcaccctaagactgacttttcatgaactttaatcttctgcatcgagagtccctataaaatttaagaaactgtgacttgtaaatatacactaatgggcaagtaggtaaatataaactaatgaatgtagaagctctgacataataattaaatcattgtacttctggtaatgaaattacagttttcttttataaagttagcagcattcatacatctagttatttactacctaatgcagagagtccttgtcaataggagccttaggcacagatgtgaagctagcataatttgcctttattccctgcctggaaaaaccacttctttcttggctctccctataaatcacttctcttcttccccaagattcacccccacccctatgcagtggtctctagcctacccaccttcaatatacagtggaatttccatttccatactccaatggaagaaaggcccttcctccttcttgaatcaaaatgtaactatcttatgccccataccctcaagtttttgctcttttttagggaaatgataaacccattcaagagaagtgttaatagctggagagtcacagacatactcactttaagggacttctcaggtctctaaatctagtgcagcccaacacccatgcagtaatccctattacagaagcacaggcacataagtggctttgtctgggtagttgtaatcctaaaaatttatggctagggaaatgtatcatccacccctcaacacacacacacattgagaggctcattgtgcagtgtactttattcatgaacatgtaactctctaacttctcttacgtcttgtacttctatcttctgatcaacacaaatgtctgcttttttgtccatatattaatcctttcagtattaaatgtggctatcttgttctcttctgtctcttctccagaggacagagcctctatcatgaaatggttcctaggcttcacactcttccccgctaacatctcaaatgctttcagccttttaaaattatggttccccaatccaagcctagtattttcagtgggtacacaggggacatgtccttccttaatctgtatgagatgtttatagtaacacagaccaagactttgatagaatctcatcatgcctctcctgagtttgaggtcagctaaaacctgcagatctttttcacgagaaaatgcagattgatgttttaaactaaaagggaaagttcattaaattatttgttgttcttttcaagttttatcttgttattgctagggttatgacctttagtaattcacaaaaatactctgggctgatttttcagcttgaaataaaggtttatgccattatttatgctcatattccccttgcaggatgtggtatggatcatggagaatgaacgtggggtatatcacaaagtgccagacacaaatcgcctctgattgatcacattataggctttgctttgcccactcaatgtattcagtggtagctagttctcttgttggctttagcctatcactattgtgtgacaaggttgctctgaatctaatctcgtcttcctggctagtagcgtatcagctatttctacatataaaactccttttggtttctcctgaggtcaagatagtcccaagttaggtctctaatacccaggattcaaccagtgttcttttgatgacaagatccacaggcttttaatgtttgagggtcagttcattaatgagtggttatttaaaaaaaaaaaaaaaaaaagcaccaacataccccacagagctgcacaaagtatttctgagttgaatcgtttcttgtattttctgatttctggtgtgtcgctatgaggccgaatgttggttgggtttacatttaccaccgaaatctttcttgcttcattgagtttggcctgttcttgcctaagaagttcgctagtaaacagagctttgagaaaaagaatcagagaagtcagtgacatcttaaaagataacttatggagatggggcttcaaaacactatgatttctccttgtttggtttgaattatagtaaaggcaaggaaactctgaaactctccttattttacactttttttttgttttagtagaataaagtctaagtcattcatcaaaggaatcttttattcattagaaaaacaggcttatagacactacttgcagagtctagaaagtcccaaattaaatacaccatccccactcttgtatataggcaaaaaagatctactttttaaaattgcagtttatcagttgaaaaactgtcctaagctgactttgatgattaattacttgaagaagattagaaagcaagactcctttaaatcagcctgatctttgtggtgggaagcacacacctagaactcaacacaatgtaccatacacttattaagtgcctaatgtgtgtaaaacattgtacccagaaattgttttggggaaacatttagttatgttcagagatcactgaggaacagcttttcctagggtccctatgtacccctgggtctaccagaaacgaaatagaagagatgggaaaaaaaatggaaagtaatacatttgttttaggagtcctacagaaataataattttaaaaagtcttccttttaagataggacctaagcagtaatcagcttaactactgaactgaggattaatttccttatcaggtcataccagaaaggaagacgaagctgttttttaaacacagggcccttcttgcttacctgcggctgatgattcctcatcctcttcatcttcatcagtgggagacgtctggtatactctggggtccacaaagggggtgaaggaggctttggtgctgctccccatgccatactaatcaataagcaagaagattaagaagagcagataaatactgcaggaataacaatgctaacaatactgtgcttgggctgtaaaacgatcacagattcttcaaggtattcaggtgttcacattctagtgctctagtcagtgcgtgcctgtctccagcttcttctggtattggttactcactagtcattgtgcattcgtaggacttcattaattatcagactgcaagaattgtagtgagaaaattacattttggaccacatgtggcaccttaaaatctgtaagatcactgtggtgacagagcttacctctccctttcagtaaaagcaacctcctatattgactacttgatcaatatgaaaagctgacataattggcaataaactaagtaaggaagcctatacagcagtactttatcctgaacagagtcaaaccaaggggctttctcttggggaggagagctttgagcccttctactctggcctggtgatgcaagtgaattggtgttggctccaaaagctttaaaatcctcaattcagggatgattttatgctggaattgaagatatttccttcccacgatagtttccttaaaagaataattacatttacatccttatttagggacttcatgaggatattacgtttgtgagcaatgtaccttgaaggcttactttaaaaaatgaatcttgggcttgaatggcaccatgaaaacatgatgtcagaaggagatgagggaacagtaaactcaatatcagggttttatgtcacaatattctaaatttgagttttgctgaataagctgcaatgtcagtcatgtccatttcttctattcttgtcctttaacatcataaacacatctgtattcaacataataagcacatcttttttggataaatatctttaactaaaggttatttcactttagttttactgttaggtttttatttaaaaataaaaccaccatccaagacctctaaacatataaggagaaaaccacaaagatctaatctgatttaattcaagattttctttccatcctatgaaatcaaaaccatttcatcctcctcaaggttgaattccccctaccaaatagaacactttcacgtacatgttctcttttgatctttggaagatgtctgtgaaagaggtagggcaggcactaacatttccacatagagctggggcagcagcagaatttgaaccagggttcaatcttatggtgtcctccttggtaccaagagaggtgttcaggcagaaaatgcccacacagcatgaaattacaataggatgctgtgctttgcagtatatcactgtgttcttttccttggggtatgcaaagctcatctactctataactttagaattcaaagggtgcatcataaaaacttagtgtgtggacaatgtcaaaaataatagtacatgtgctttataaacacatttagggccttacgtgtgattgacaagactgttaatgaaacaagactacacactgtgaactcatccaactggtgtcagtcatcagcgtctatgggcactacctacagattgtgtttattcagacttttcgctggggctgtttctctacaggaaaggtaatgcttggtttctttcttctcacacaattttgaatttatgaaagatgaacactctaagaacttatctatttattaaattttatttttcataaacaaatcatttaaacttcattttacttaagtcatacttagtttgactaaattaacacaaatataaacctcaactgttggccttgaaatctgtgtagcctgaagtttccatcagaactggaggtcccagttctggtcttagatctgtcacaaaccagctgtgtgtcttggacaagtcattcaacctctgtgaacctcagtacactcatctgtagaaacaggtattggttcagatgatatctgagaacttttcactgctctgcttccatgatttctctatttgagtatctgcataagtagctctatggtagaaaccaaccaaacaagtttcaaggagcttggcgaagcctcattcttgaagagatcatggttttagaaccccaggaaggacagcagaactgtcatgtcagctgttgcccagcacctacttcagtcccagagtccatctcctgggaatgggttgagacgcgccccagtccctcagtcggggttccagctggagaatggctctgctgcaccaggtcagggaggttgatgtggccagcaaagccattgctgtcactgtggccagatcgcttcttctctccagacgtctgagggagcacagcacgtgggaggagttagagaggggggaaaaaggccacagagtgacatcagccctcacacagcataggcatacggggctccaaatcaacccactagggcatgagaaggtgatattcacatttctattttacttaagaaaacaaaaaagaaattaagctttgccaatatttagtttatggattgagcctgaagccttacgttcctgcatgaggtacagacagtggtcacatatggcatgggagtcccatgtacagagggagacgctacaaaaagggagggactgagcagggcccacacttgtaaactcttttgtagtacttgtgctgtatgcacctgccacttatatatatttacagatcatattaccaggttacaatgaaacaaacccacacaacagataaacgacctaaagtgttgctgaaaagaagcagtgtgtgtggagtactccaagaaagggcagagaccatacttaactcacagggctctttgtcattcacaaggtcaaaacaatgattaatcagatctgacaggagttccaaatatattgacatgatctagaatactatttgaaaatatggatttacaactatcataaatgtttatgtctcaataaataactatggtgctttgtgatgtaggcagtaacaaagtcataactagcaaagcatttgaaacatcacctctaatatccctttttaatgtcctttaaaggtttttcttttttttttttttgagatggactcttcactctgttgcccaggctggagtgcagtggcgcgatcttggctcactgcaacctctgcatcccaggttcaagcaattctcctgcctcagtctcctgagtagctgggattacaggcatgtgctaccacacccggctaatttttgtgtatttagtagagatggggtttcaccatgttggtcaggctggtgtcgaattcctgaccttgtgatccacccaccttggcctcccaaagtgctgggatgacacgtgtgaaccaccatgcccggccaaaggtattttataatgtatataatgtcagtgcagtagaaaaaaatgtatgacttgtgaataaatacactgtattaggtgacacgctgtacagtttttactgataggattacgtgatgtaacaagtttggaagccattgctctggagagcagtctctgccaaaaaaaccccagggaggaaaggcaagattaaaagacaactctggtttccaaaagccagtgcccacattgtaggcctgactagtgttgcactttttaacttttatgcaactggctcattgaggattcttagagcagatctgattaagtgatgatttccctctctgccttttctttcattcattcatcaacacagtattttttagttcctactaagtgtaaagcattctactggcatgtgcaaggtttcatgctgtttctttgaccatctcaccagcctagctttttacttctggagcttgtcatggatttgcaattacagctctctgcacctgcctctggctggaagtgaaaggaggcacttcttttcttttttcttgtttagatgaaacagactcccaagctcctgtaatggtgcatgtaattgatgtttccaggaagcttgagagataactggaaagcctagtgtcctttgtgtttcttggcaacctgctcctggactacgagctgtcctggagaggaacattttctggattcattttgtcacagtggccatcagtagcgtgtattagtgcctattctcagagttgagcatttccttttctaaatgacatttaggaaattcagtcctaatacatcttattgtgtgctactttatgtatactgggcagtttctcctttcttttaacttctgttcaaatactgaaaagcttttaaacattttccccaaacctctctttagcataaatcacatgtcatctctttggaattttttggcctctcttgtatcagcagcactctttctcaagccaaaaactgatgcagacacactggttatcaaagagagactcagagaggctaacaaggggaagtggctcagatagtgagaagcttaaaggaatccagtagtatgctctgaatctgcccacttctgagtcatcacccttttgttcactccaccagcaccttcttattaaacactttctgtgtgccaagtactgtactggaaacacaaagacagatgtacaacagccttaagaacctcattaacagaacctcaataatatctcgtctttatctctcaccattcccgtggggattggcacaaagatgttctgtgtaccaccacatgccaagtactgtgctaaacactttatatatgacattccatcaattatcttgccctgagtgacacgggttctaagtggtttgaacccagctgtcctatggcagagcccaggtgctctgggctgcactgttgtattagggggcctactcctggtcacagctgattgaatcaggggtggatgcctgagccaagagggaccagattcccactggaatttaatattaagcccaagagacatggatcagtttctgctggcagttgaactgggatgtggtgagtatcttgcaatggaggaagtggagaggtgaaagcaggagcatgcagagggagagaaagctcctctacaaagagagagaagagcaaaggagaaatgtggaagaaagcagagattagggtaaggagagacaggcagcaagagagccagagacctgcacatgagaagctgcctgagctcctgtctgttccagtccttcaaagaggctcagctcacttttacctttgggttccttccatgaaataccctaaatcttcctttactcctctatttctgatacctaccctctcccgacttaaaaaatgttcttttttttctttcttttctttctttcttttttttttttttgcttactctgtattaagtgggttcttttactcattacttgtaacccaaagagccttcatgatgacaagctagtgttctggttcagtgaggaggatcaacgctgaaaagataccaggaaggtgctgtgtacaaaggtccatggagtcccagtagaggcttgtaggagataaggaagattgagaacagggaccttcttttggtgaagtgtgggtagcagtggataatacaaaatacctcttccagcagatgagcttccatggacaaatggcagctcacagctggtgtggtgtattctagaaccgagtaaaaagtggtcctgtggggctataggacagggataggtagaaccacagggataagggtatgcactacaaggggaaatttgtgcatctgacaggatcatgagtgttagagtggtatgttcttatagaaccatctagtccactccacaagatgacaagttgggtgagttctcctaaagttcatcttggagaactgtactaatagcaccctataagctaaatcttattataatgagtttttattttatgttcttattttgtcagggataaactttaacctgcatttatcttgtttaaacatgtacttttagtaattttcagctcaaggtttgatgatggttaattttatgtgtcaacttgactagaccatggggtgcctcggttaaacattttttctggtatgtctgtaagtgtttctggaagcaattagcatttaattggtagactcagtaaagtagattgccctttccaagtgggatgggcatcatctaatctgctggggacctgaacaaaacaaaaggcagaggaagaaggaattttctccctctttttcttctccgctggttgaagtgggacatttcatctcatcttcacccagcttccaactaggatttataccaacagcttccctgggtctccagcttgcatatggcagatcatgggacttctcagcctccatatcatatgagctacatcctcataatgaagcagtctctcggccgggcgtggtagctcacgcctgtaatcctagcgttttgggaggtcaaggcgggcagattgcctgagctcaggagtttgagaccagcctgggcaacacagtgaaaccccatctctactaaaatacaaaaatttagctgggcgtgcacccgtagtctcagctacttgggaggctgaggcaggggaatcgcctgaacccaggaggtggaggttgcagtgagccgagattgcaccactgcactccagcctgggtgacagagcgagactccatctccaaaaataataataataataataaagcagtctctctctctctacatatgtaaatactctctttctctggagaaccccaactaatacagtttgttatttaaaaaacccacattgaggaaggcagaattggaaattgagaggacaaaaatattttgggttccttaatagatcaaattcctataagacactggcaaatgctattttctttctttctttctttctttttttttttttaagacagagtctcgttctgtcgcccaggctggagtgcagtggcacgatctccactcactgcaacctctgcctcccgggttcacgccattctcctgcctcagcctcctgagtagctgggactacaggcgcccgccacgacgcctggctaatttttttatttttagtagagacgggatttcactgtgttagccaggatggtctcgatctcctgatctcgtgatcctcccacctcggcctcccaaagtgctgggattacaggcacgagccaccgcgcccggctgcaaatgctgttttcaaagtgacaggttgtggtcatagaatactggagtgctataaataacatggagccatttggatgtggctggcaatgaactgaaaatgtggctccaaatgtctacttggaggtattgactctgtcataaagactcaagcaaattttaagccacattagaaatcggagtccttttatctggagtcaaacagcaactcactccagaacgttctccctcatgttttcctaagtggtaagttatagggatagaagccttctacacttccattgaaattatccattaaccacatgaagagatttatatgccagcactacacaatgtcaatttcagcagccaagtccatttttcatttcaggcatatgtgaaaggactctttaaaggctacttgaaagattcaacaaggacataaaatgaaattctagcaagttgctttgtgaactagtcttccagttatagccccactgctaattattatttcaaaggccttattcatctcaaaactacagttcctttctttcttacgaaagtgagatgccctttgcctttttggagagcaaagtctgctattagagtttcccaactctgtcctggctgaagaggaaaaacagatgacatatgtttatgtttcagagggaggactggatggtgataacaagtaaaaggagaattcatttccgaggagagagtgaaataaaatagttaacatttattgaatgcttaatttactaactcaatattctcaaccatcttataagttgtatgctattatttataaaattttatagatggatgcagggagaggtcaggtaacatttgcccaatgttctcagccatttctttccttccaagtaaatatctgcactcaaacttgcatggtgatgatgaagtgaaaaagaggaaaagacggatttcaatttgtcagggtctttctggttagcatggacacagtggggagttactgcatgtcagaaggacagatgaaagggaacatgtgccaccccccaaatgaaatgatgttcctagagtttaaaaaaaaattcaaccaaagttccaaggtacatttttgaagtagatctgcctatttctttgttatttcaataaaataacttaacggttgttttaatgttaatttaacaagataagatgatatcatcatttcttggaactattgagcattttttatacgaaatccactaagataaaaccatggggagaagagacataacaaggccagtgatgctattcagagagaccattcatttctgttttcctgttgtaggaaacatctaagtttgcaattttatatcctcaggcccaaattctatattctgatttgcatagctcctgctgaagaatttggaataatataattaagtcacactgccagagcttagaagaatacaggaaagaaggcagcagacaattaaaatcactcaactatttggaagcacaggtcctccctcccccaagaattccccatacttaaaatacatgccataggcattctctgtgaaagctttaatgtaaaaaccactgaagaaatggcatttcctctacacagtttttataccaacttacctctctaatcatcaaggttccttctcttgaaatactgccgctgaaactgtccgcatgagaggtctccagcccatgcgtccccaccattcccacattgtactgctcgttgctgcctggagctcctgttggtctgagatgagaaggaacaacattcatggcaatgtatctttaggaaatatctgtttcctgtccatattcattatttttgttatggtaaaatatacatattaataacataaaatttaccattgtaccaattttaagtgtacatgtcagtggtcttaagtacatctcatattaatttttttttttttgagaaggagtctcgccttgtcgcccaggctggagtgcagtggcgcgatcttgactcactgcaagctctgcctcccaggttcacgccattctcctgcctcagcctcccgagtagctgggactacaggcgcccaccaccacgcccagctaattttttttgtatttttagtagagacggggtttcaacatgttagccaggatggtctcgatctcctgacctcgtgatttgcccgtcttggcctcccaaagtgctgggattataggcgtgagccaccgcgccctgccaatctcatattaattttaatgtgtgttgatgtctggactggccccacttttgcagcatcccctcttgacctattctctgcccagtagccagactgagcaagtgtttggctttacctggaaaaaacactgaagttggcaccaggagtcaccaggctctgcatgatctcccctgacccctgccctccttctttgggcagcagacaacctgacctgcttttacacatgctgttccctctgcctggaaagttctttccactctggccttggttggttccctctcattcatcctacatgatgctttctgtgagaagtctgctcttatcacctatgtcttgtcccaacagcccctcttcttttctcttcaccctttttccttcatagttctcatcacaatttgcaattatcttatcttttgaattctccctttctccttccctctcattgcttgtgatggcagagtccttgtctctttgttcattattattacccagtacccagcctagagttgtcacatactaggaatgcaaaaaatgattattagatccatgggctttatgcttctataaagaagaaatatctactaagaacattctggcttattggggcatccataaactaggaggtttaacttaaacagcactcagcctctgtaatcatcctgcatggtggtatatttattttcagttcttttcttgctatcatgtttacagtataatgagagaaggtaacaggatctcagcatactccttgagaacacagactgatgtttcctgtgtcctgtagcacagagcacagtgccagggctcaaaaagtgatgactgactgctcatagtgagcttcactctatcaggagtgcctcatttgcatgacacagaatttctctggtttaggagctcaggggatttgagaaccacacaccacaggttgaggttggtacaacatggcttctggaagaaggattttggttgttaatgcgatacttgttgttctcctattttagcatctgcctctcttttaaagtgggttttctaaaaataggaaagttatcaaggcttatttctctctaggcatattaattgcaactttaatcatttttttcttttattttcattgtttcttatatatttaaaaatatctctggcctcttggatcttatgaaagtccaaagaattactggaaacttccatctaagaaacaagaaatacaccagatttatgatgtctctggggcagagaaagacatatttcaaggatttttatccaaaacagacaggtgaaaaaatgacagggggagtccagacgagaaaatgtatagtaagaagcttccattgcaattactaaactggagcagtggattgaatgaatctaaatgtgggctagaactgatgtgtttgggaagaaattccaaagaggcattttcattttcaacatgtcattcctagaaaggagcttttaatagtgttcagagacatggaaaaaaaaattgaattcctggcattttgatagattggtaaatcagttttcaaaatatcatttcttcactcatttgtttatcttgtgtgtatcttccatttttttttcttgctcttctttcttcctttgtgccgtaagtacttgtttgggacaaaatgatataaagccaataaatcaatgaagtacttatcaagagtcttccatgagggcagccacttttcttatttatcagaaaggggttctttgctattgtcaggggctcagttggcctggtggcatctgccaggctgatgcttgtacaatcaagttctcctgtcctagtcagacctgcttcctctgttacctgaataacagttttcttggtggccaccccgtcttcagtcctttccccctcatatccactcctcacagctgtgaaagtgagccctccaaaacacaaatctgaccaagtccgaatcactcttctactttcaatcttcagtagctccctgtcaaccacaggataaacttgaagctccttactgtggcttacaagctctccattatctagttcttgcctgtctcactaacctaattttttttaacaaaatcctgccccaactcctaactctaccagcatttaacttataaaagtttcctatgtacattatgctagaaaatccctggtgactttagcctgccctctttacctggaagattcttttctattctctgcctccctctggctaactcattctttaagcctcactggaatggtttaggtggctcttcactctgcctccacattgccctttgtgcatctctaccactgcattcaatacacagtcctgcaatgatcagatctcattaatgttggtattttcagtgccaagcatggtgcctggaatgcaggtagcacataataaatgtttattaaatcgctgaagatcttgggtcaagggctttgtttaatgtctaacagagatttcattcagatttattgtaaaaatatagctcttctgtgaattgataagtaattggctatcaggatattatttggatatttaaaatatcttgagcaatcaatgttaagttttacaattttatgaagttgggtttactaggatgtgccaaaataattttcttataattgggtggttatcatagaataacaaaaaatctattcagatatatcatagaactttacaggaaaaagagttaaacttaatgtatataaattttaaaaaatcattgaggagatcagaagctcccaggaaagaatgttaaaaactgtgataagagaatctcaccatattacaaatgtatgaacaacttcagtgaggagaaatgtggcaaaaaggcattgatctaagtaaccttggaaatgagtggagtctgtaatactaaaggcaagaggaactgagcaataaacagtgtacattctagttgagaaagttgtttcccatgaggttacaggttaacaaatttgatactactatacaaaaatactggatgtgcacaattaagtaaatgggtggttgatatggtgtggccatgtccctacccaaatctcatcttgaattgtaacttccataatcccacgacatgggagtgacccggtgggaggtaattgaatcatggaggtgggtttttcctctgctgttcttgtgatagtgaataaatctcaggacatctgatggttttataaagggcagttcccctgcacatgctctcttgcctgctgccatgtaagacatgcctttgctcctcattcaccttccaccatgattgtgaggcccccctagccatgtggaactgtgagtccattaaacctctttttctttataactttatacactctcaggtatttcttcatagcagtacgaaaatggactaatacagtagttgatggcagaagccaggtttctgactgttggaatgggaatttacaaacaagcaaggggaggtggaggcatgtcagtcaaagaggcacaggagctaactgaaagagctcccaaggtcaaaactggaaaatttgagcaacaaaataaagattatatccatgaatctatactgatataaatgatggaataaattaataaatagaggagacaaatctgtgcagaagaattctaaataaattatgtagctattctaccctacaggagggaacgcatgattccccactcctcaagtgtgggctgtgcatagtggcttccttccaaaggtatagcatagaaaaaagcggaaataaaagagtcattttacagtggagaaatcttccctactggagcatttgctggtatttgagggaagacactaatacctaaggttgcctctttggcttgcttgatgtgatgcaaatcaaattaaatgcctttccttccattctttttattctataaagcttttatttttttcctgattataaagtagtacatgcccatcatataattggggatatacataaaataaaaatctcccataattatattacccagaggtaatcacttttataattttggtgtatttccctccactcgttatttttctatgcatgaggaattgggaaatactgcaactggttagttggggaatacaaacttagttaagtgcactctcataagttatatcttgtaaaataaatgcaaaaccagcacagtgcatagaaaaaagctattgttttaaacatcagaaaccacagctgtttgtcaaaatggctggtgctccatttctgagaagcttctctgtgtttacttcatggtgggcactgagctacaatatatttttgttttctgctttaaaaatatatggcacaaaatatagaggtttaccttaacaaaaaataaaggtaataagaatgtatataaaaggcactctggcccccaaatactcaattcctaaatattgttttataatgaacttttaatagtatgaaatttctcaggcatgcaatcatcacattgtagaacagactgtgtatattttatatgcaatataaaaatacatatatttacaaattgaagtaaacatacacacatacatttgtacccttcgtacccttattttctcacatacataatcacatattttaaatgttcttaaacaatcatttccatctatctaaagtttaccaatcccttaagaaccatgtcaagtcttgcctccaccatcagcattccatgatagcctcagttcattatttcttatgcagattatagtaatagcgcctctgaattgctttaccagtctccagtctgttcccttttcaaatcgtcttgctgaaataatctccctcaaatataacactgaactcaagatacgttcaatggtttccaatggctacatataaagagcacacttcttggtctgatttcactagtccagactcccctccaccgtatacaccatacattcccaccaaagtcaactttctgtgtctttacttcaactcttccccctgcttgggattctaatattacctcaggatttttttttttttaatcttgctgacagttatttgtatagaattggctatacactcttcaaagtcagaacttgcaatttcaaattcagtgcaattaaatgtaaattatagtcactgaagacccactgtattccagacaccatggaacgtgttaagagcaagagagatgagtaaggcataacccttaccctgaaagatatcatagtccagaaaaggagacaaagacctaacaaacaatcctgattcaaggcactacatgaagatgcaggaatacacacaacatacagcggtagcacagaagagggggcaggctctacctatgcaggcggggctgtgagtaggtgatttctaaaggaacaggaaatgccagacagaagtgaagcgtggtctattcaggaaattttagaaaggtgggtgtttctacagtggggagtaagtcctagatttgcctttaaaggtaggagggtgaacaccattaatagccttgcaaaatatgataggggacctaaaacccaaatgctaatgaacatctttggttgttcctccaaatgtttatattagcctgcagttttccatgtgtaattttgtcattctccaactagcatataaacttttggaagacaaaatccaagtacgaacttatcagatctcttaaagccttcagcagggctatcacatagtgagagttttagcaaccttttaatttcataatcttctctcatcctgatgcttgcatgctcagtgcttaaaaggagttcaaaacatctgtcagaagaattaagcaattctgagtcaagacaaaaactaaaagggccagcatgttttgcagaaatgttctggattagtgattttgcctctagaacaattttatttacttttaaaaaggcaatttaatgcaatttgtttcaaaatgtcatattttagcatatttagagctgtcagcaactgggtcatcaacagcaaaataaccagtatggatttttcagctacgttaattagatttgcctcttagaatcgcttgtatgtaatgatgttaatcagtgaatgacattccctttagactggccagccctgcctctccagtccctgctgaagtggacaataatttgtggcctgaaatggcttcttttttatatagagtgagtgtgaactgataatcaatgctagtagctgagccaaagaaatagaggtgattgaagtgtgaagatggaaaaattagcatctcattctatcaaagttgtaggagaccagggcacaaacaccttgtgcttactaggtggaggaactggggaagcaacaggggataagggtaggttctttcacgggatccactccaataagaaaaaaaaaaaatgaactttctcctcaccttgaaaaaaaaaaaaaaaagaaaaaggctacaattactaaagaaaatgtaggtacatataaatatacatgtaaatacataaaaagagaactgcaaagagactgacagtatgtggcaaagacacagaccacagaaaaatggatccagaaaaagaagccatgaagggaataaagtagaaaatcataacggggtatattttggaactttctctgcatgattatctgagtcctgattcttttgctgggatggtaacgcatgctggcttgtgcatttctccttgcttgttggtggcagtggtggtaatgaaatacatgttttatgttgttaattttaatccctaaatgtcattgcccatgatttcagtgtttcagttttagaggggaaggcacgtatcaatggtctggttgtcgatattgtttgcccttaagatgaaaagaacaagaaagagtcgccgaaaggatagtcaatccattggcaatggataggtaaagtgtatgcagtccaaaaatgctacatattctaagtgattgtgtccatagatagagataattatagaactatgctccaacaaaaacccaagtcccgaaagtcaatttatcttgccacagacccatatacaatcttacatttaactcatatttttttgtccttttattttggaaacctagtcccctcccggtctacactttaaaagtagttctcttacatcagtctgggtatgtcgctgacagccactgtcccatcatgggtctcgctctctccatcttcctcctcttcctcgctactttctgactcctcactggaggaggagtaatcagtcaccttcttcattgggcggtttgtttcttcaatccggagttctcttagttctttggctaatgccgtcagatcctatgaaagaaaaatttgttcagcatatgagtggtagatacgaccaaagctacatctctcagcaagtcagtgctccagcttaagcaacaagaaaaaaaaaagctctatatagaactgtgacaaacatagttactgcatggaactaagaaaatgatgtttgtagcgtgtagaagctagaaaagaaagatgaaatcaatttaaactttttcaaaaccaatagctagactgagactgttcagtcctgaatatatatgtgtacatatgtgtatgtacacatatatacaaacattgggttctcattttgttttggaaaggtgaagctggtcacccccagagttaatgggaaaatatgtgggattagaaattgtgccccagtattctgggactcctgcccaagccacagtgatggcttttcccctcttatgattgctgctgtactgaaatttaccatcagtcagccatagaacagagcaactcccaaggttccagctactacagtgactcatttggtgtgtcatcattccctggagaatggaggtaccacatcaaatcatggcccatcctaaagtctagtgccactgaaatttacagccacagaactgaattaatcaagaggaacaacaacaacaagagttctcttccaaaatgataggtgtttcattttcttttgttttaaattccagtcatctggcagaaatcctggtgaagaacactaaaatgaatgtgcaaataccaaaaggaagagataattttgagttttccatgagtatgatgaaacctttagccttatggatgtgatgatgtggtatttaatcaccaggcatactgcaggcagtgtgctgaatatccgactaccttttattttacatgctttcagagtaatgcagagggaagcagttctgcaaaagcatggccgctctaatttgcatgggttaaactgcccatggcacacagcatgcaaatggggaaaaagcaatttgacatcagtcttaccatttctccctatattagtgacccatgtgggaatcagagcattcagtgagagacaggggattagggagaaagaaactcattgaaaaatactaaatcccacagttttctatggccatattctctctttatttcaatccagaaatgtatgcatccaattcacctgatgtaggattagagcaacctgggtgatgacattgggtaatccatcctaatcggttaaaagaaaagctgtgataaatgtgtatagttaaattataattttattttgagaatacaacaaaacattgtttctctactgccacctgtatgtcaggcattactattttggttcacactaggaaaggaaacactttaggtgttttacgtggtctagaaatttaggcaattcatagtgttaactgaagggtcatttctttctaatttcatagaaatcaaagggaaagcaaaatggcttttaaatttgtcttgatgacacctgatttgaaacccttagaatatggaagctgctaaaaattcaacctttgcattacatacagaaacacacttggctagggcttttgcacacatgcacatttgcacatttgcacatgcctcaatctcggtgaatgtatttgctccatctgtgaaagtgaaaatagaattgtatttagaaggccaactctgtttaaatgtaatgcatattataaaaagaagaggaaaaccataacataggtataatgttatgcaaatttctggtttctttggcaattagccaaaataggaaaagctaatatctgaatttcaacttttacttcttatttcctcctggcaattgtcaatgcttatctttatcaaatgaagaagaaagtgaagggtatgctattcttgagtaccatgggaaaataaagtctagatatttgttaaggctatgaaagaaaaggatattatcatcctccaaaccagtgaaataatgaaaaattagataaatttattttgtattctgacatctatatattaggactgtgttaagtctcatcaaagaatacagctagcatttaaaatgttacttgttattaagaattacattttatataatttaaagagagaatatggtttaaaagagtttatctctattgttaataattctgagtaaaatataatactcttggctatggtttaattaatgatacattttccccagaggtttattttccttttctctgacatttcaaaacgagacaaaagaaattctaaaaaatcaaaattattttagaaatatttagtccacaggctactgatttaaaaaaactttcacttgttaaaatgacatacatttttctaaacattgtatttagaaacactttaaagttctgaactgcttaataattttgcttttaattagaattttttgcttctgtgttactaaaaagctctctgccctgaaacattagaaataacaattaaacttaaaggaaattttcaattaacagtttggaggcgagacatataccagaatccctatgaaaaggtaaaaataatgaataattccaaagtaatacctgtagtcaaagaaaattaatcttccattgctaagaacctatgtgtttagctgaagttttgtttcttatccgtccagtattgaaaaatttataatagcaaagttataggaaataaacacaatctaatattaacaccattgggttcaattctattttcatatattttattctttgacaatacaaattttctccatataatgagccttcttggtaatttattacttggctgtcacaagcctggagctaaaaagtatttaaaaaacaaaataagtgctatttagcatgaaaatatttgagaatatatagctaaaaaagaaatatggcaagatggtaagattttttgactacagagtaaatgtgaagatagctacgaggcttaacagtttttagaatcaactagatataatttttcattcaacaaaggttaactattatgcacatcttgactaaaaaggcgctcttttaggtccctttttagaaacaatatagtttattcaaataaatattagttcaatttttgaactattgtttaaaaatttttagcttttttttctctttgtattaaactattttctttttaggaactctaaagatatgacattgggcaagccacttagtttcaatatcctcatctgagggaaaagggggttgaacccctagttattgttcaccttccatccaatctaaattgatgtgctttgaaatttttgatgcccacatactaataaaaaacagcggtaaaaacagtgttttcttacgtgtataatctttgtgtcacatatttaattgtgccaacagagaaaacccatttattttcaaagactatattcaaagactatattaaatagactatgctgcaaaatctcatattccattagaaagcaatgtcacattaatgtacactcccccaaattaatttttataaaaagttaaatcattagcaataacaagcgacaatatttcaaaagtgattttcagatttttcatttcaatcccagttatctaaattgcaaaaacagtcgttgagagggaagccctaccaaaacctatgaatggagaagggagaaaggtgtagttcaaagtttctcaattatggccctgttgacattttgggccagataattctttattgtagggagttctctgtgcaccacgggatgtttggcagcagcacccctctgctctatccacaagatgccagtaccactgcctgctactctgaagtggtgacaaccaaaactgtctccagattttgccaaatgtctcctaagggaagaggagtggaggaatcagccgtggttgagagccactgggttaggtagaaccgctttattttagtggtttggatcagtgatactcaagagatcaggatagtcacctggagggcttttccaaccatacatggctccagagattttagtatgcagctcacaccccctcaattatttgtaattacgtatacctccattgccccctctcatctctgtccagtgtggtgcagtacaccaaaaaaaagtagagcaatttttcaaagcctaaaatattctgggttaatcagatgaaatctgtgagagccttttccttaatgacggcccctccaagccaatttctgaactcatgtaattcctcttgagttctgcacatgcacagccattttattggcaactgtagcaccagaacttcactgtctttctttacctgttctgggagaaaactgacaaaagttgtgataatccctgcccttctcactattatgagagagaggggcaagcaaggccacggcacagagcaattaaaaacacactctcctcttccctttctataaatgccatccacacaccgcaaacatgcggagtctcattcttttataagcaacaatccttcaactatgatcataactgtctcgtcactctgggtggtgaggtggccataagtctgaaaaagtgaggctcttcggtgaagaccagatacatggaaacatgcttctcctacctgccaaaatagctccatgcctctggcccaaaccttaatcaaacccttggctttctgcagcaatgttacacataaaatgctttcacacacattaccttaaatgatcctaaacaatcttgtaagtgggatggggaggtgtttttattctcattttatggatgaggaaactctggcccagtgaggttatgagactagtctcagccagttatttactgggggagccaagatttgaatgcagcttgctgacctcaaagccagtgctttttccattaaatttcacaaaagtagtgctcagcagagctacagctttaaagccatgatggtagtctttagattccatgcatttaggactctttgcaaggcctggatcttaaaaaaacaaattctactctgctgtattcatgcaggtctgacaaatagcagtaaggcagtcatccttcttagcaagctacctacaactgacaaagccatatatttttctaatggaaaacgtctccacagacaaggaaataaagtcacttaactttccaggattcattaactaaagctgatgttgcttctgatgctgttgttaatgtcccacaaaattaatctaacaatacctactaactccttgttcacaaatcacacactctaaatttggagtgtcctagaatgatgtctcttttcttgttagtaaaactgctgagagccattccctagcaaggctggcaagtacaggtttgctattggaagatactggaaggagaaactgccattaataaagcatgaatacttgtcattagccagactggaacattggaaaagtgacattttagcttagaaggaaggtctctgaagctatatgggtaggtttgagggtcttaaagttggcttccatttgaaggggcactcctcccagcagattgctacaaatctcctcccagctgattgctcccattggccacctttctgaatgtcaacattaggaaataagtttaatatttacattttgtgaaagcatgaccaagaaaaggtaatactaacctcatctatagcttttttgtagctctgaaatgagaggaacccaatccagaagaatccacagaaggaggaaaagccagcagaaaggcagcagattagacacaaaattgtaattgttagtacgcaactgataaatacaaaagggcgaagagaatgtcaatccagaatgatgcaaatcccttcattattactctcggtatacgtcgttactttaagatgttaaaaaagagtaaaccaaaaagcttcacgttcattttacagaaaagattctcaagagatttaaatagaaaaaatggatagtaattcatcccaaattaattttcaactttcaaattttagcctccatactcctctttaaggctacctgggggtctatcatgttacagcagtgaagctggatgctaagttgttacgacgcctgttggaccctgcttaaaaagtttggtccagaaaatatagtcctggaggcatgaaaaatagcagaaaaactgtaatattaattcatgtggaaaataatatggggaaagagtagaagagattagagaagttcatagaaagtacccaagtctctttaactgctactttcaacatctttttgccaaagttgctgagtagaaattatggaatgataggagttgtttctcttcctgttttatagttaaaggactgctaatgatcagcaaatagccaaaggcagaggagtcaatccaagatctcttcggttctttcctaatcaggtatgactttcttcgggatgtttctagcatccgttcttactaatctcaacaatttttgtttgcatcatgagtgtatccccaactacttaatcctgtgggttctctggtaaattaagagttcaaaactcttggagagaaaagcactcacagctggtcgactgggccgggtaatgtccctggattcttctggtttcaccttcgcaggctcatgggggagcacaggtgatccttctgacttactgttggctagaggaaaaaaacagaggaccaagaaagagatggccatcaaaaagtgctggctcaagttctgaatgaattatctgtgatgtgtcatcacattgagattactcagtggacacgtcattcacctgggcaaatcctcaagaaacatccatgaaaaatataatgttcaggcaaacacatttaggcttgtgacctggaaatcactagtaacaattaaaaaaaaaagaaatgtagcaagtactatcaccactagagcacttcttatgtgtcaggcatagtgctaaatgctttccatgtcaattatctcatttaatcctcactccaacccaatgatatggcactattctcctattttacagaacacagatttacaaagatgacacaactgtccggaggtcacactgaaattatagacagagctggagttctgatttctgaaagtcctattctcagtcactatgctaaatgagcctctaaggttctatgcttgttttcttcttttatcatttgtccaatcaggataggttattttgttgaaattttgtgagggaaaaaaaatttattttatttggtggaacggtttttaattggagatgggagtggtctcagccctttaaaaataaaagaatgaggtgagggcaagaagggggttgttataggagaagggccctaggctggaggtacagagcaaggtcaaggggaccctgacagctgcagagtgaatagcatctttgcagtctatgagcttacagatagagaagatgcaatttagggtaggagaggtggtttttatttcttaaaaagtagtctttcttggacagggacataccagggatacaacagcccttttaatccggaagaacgaggggctgaaggaaataaaaagtaagcctgaaccagaccagagaattaaaatggtatgcgtttaagtttggtttatttaaatatttgctctaagaatatgaagttgcctataaatagaaaaaagataacagaatggctgttttctttctttaggtgttttagagatggggctctgtcacctaggctggagcgcagtggggccatcatagctcactgcagccttgaactcctgagcttaagcaattcttctacctcggccttccgggtacctaggactacaggcgtaagccactacatctggtagttttctaaattaaggaaatttatatttcgatcaaggcaacaaagacatacagtagatacttctgagatgtgccactaatcagaagaatgcatatagaggcagctgttggctagtccatatcccaatccagagacgtgaacatcaatcacatgttagatatcaagctttttaaaatggaaatagagtgatttatttaaaaccctgaaagggtgttaggagataaactaagggtattaggaggtggtatgtaataaagagtctaagaaagaaaaaagaactgaaggttctcatgaggctttcatcagacagagaaacttataagtatgttaatatttgtcaaattgcaattaaagtactggtcttcatcacttagaagcaaaattatcttctgaagaagttgattcagaaggagtgaattttaactagctagaaacaatgtattattatgtatcagcacctggaaataataatgtttttcataggcctccccattactggaaactaaacaatgatgaataatttgaattaaatatttagagaggctaatttttacttaataggaataaccagaggagtcaacaattttttttttttttgatggagtttcattcttgttgccaaggctggagtacaatggcgtgatcttggctcaccacaacctctgcctcctgggttcaagcgattctcctgcctcagcctcccgagtagctgggattacaggcatgcaccaccacgccaggctaattttttgtatttttagtagcgatggggtttctccatgttagtcaggctgatcttggaactcccgaccttaggtgatctgcctgccttggcctccctaagtgctgggattacaggcgtgagccaccacactcggcctaaatatgctttttaagtcaaagattttattccttccttcaagtgtattctacattagtctttactgaatttcattttgagaaatacatggtattctgaactgtgtatatgaactatgttcagaatactaaacaggacaattggtgcaatgcgttcaggacatttgtgggtacatgaaactctaaaaaccggcaatcaaacagaaacagaaattcaggtgactggtaagtgactgtattttcaaataagactgatatttggtgatctccctggaaaacactggtatctgagattagaaaggattttgtccatactgatggcacacacacaattagggacagtggcccactcccgaggagactggggttgagagcagttgacaggctcttcaggatcacacagtggtggccatgcctggactagagtcaggaagtaactaacctttttccctgtccacagctttcctcccaggcagtattgccaggtaaaggtaagagaaagttttacctcgaactctggtgcgttcactggatcctgcttgtgatccaggctgggagcctccttgggagctgggctgggagctaggggtgctggagctggaggaactgccactgctggtcctctgcaaggggctctccaagatgggctcagttctccggagatcagggttgctgtgtgagtgacagagcacactggttacactctccagaccttgccagttttgcagatcacatatctgataaggtttaatacccaaaatatgtaaggaactcaaaacagctcaatagcaagaaaacgaataacccaattaaaaatggggaaaggacctgaatagacatttcttaaaaggagacatgcagatagccaataggaatatgaaaaaaatgatcagcatcactaatcatcagggaaatgcaaattaaaaccacaatgagccaggcacagtggctgtcacctataaccccagcactttggaaggctcaggtgggaggatcacttgaggccaggagttcaagaccagcctgggcaacatagtgagatcccatctccacaaaaaaattagctgggcatagtggcatgtgcctgtcctcccacttacatgagaggctgaggtgggagggtcacttgaccccaggaggtcaaggcttcagtgagccatgatcacgccactgcactccagcctgggcaacagagtgagaccatgtctcaaaaaataaaaacataaatttaaaaaccccaccaaaccacaatgagatatgacctcatacctattagaatggctgttttcaaaagacaaaagataatgagtgttggtgaggatgcagagaagagggaacccttgtaccctgttggtgagaatgtaaaatagtacagccagtacggaaaacagtatgaaggttccgcaaaagactaaaaatagaattatcataggatccagagattccacttctggatatatatccaaaggaaatgaaatcagtacattgaagaggtagctgtactcccatgctcagtgcagcactattcacagtagccacaatatggaatcaacctaagtgtgtgtccactgaagaatgaatggataaagaaaatgtgatatatctctctctcaaaaagacaaatactacatgatctcacttataggtggaatctacaaataccgaactcatagaaacagagagtagaatgatagttgccaggggatctaggaaggagagagaatgggaagatgttggtcaaaggttacagtttcacttggacagcatgagtaacttttggaaatctactgtacaccatggtgagtacagatcataacgaggtatacttgaaaattgcgaagatagtagatcttaaatgtcatcagaaaaaaatgataactatgtgaggtgatggatatattgattaacttgattttagtaatcatttcacagtgtatacatatatcaaaacatcatgttatacactgtaaatagatatactttttatttgtcaatcatacctcagtaaagctaggggggacaaaatcttgccattggtagacacaagcatagtcccgtccccagtgcaaggaagtaaaaagagcacttacaagaccttgagaggaaggggtcaacagaagatgacagtcatgccttcctctgtagagttcctgaccagctactggatgtgtacaggatgaactcttgttcatcacattgaaaatactagctctggatggtgaatcttcaaagaaagctttcttacaaacatttttttctgtgctcattgtaaaaagtcttgaaaaatattaaaagggaaaaaataaggaaggaacacacataatctctgcaccaggagatactcaactatattttactattgtacatgatctcacttatgcgtggaatctacaaacatcaaactcacagaaacaatagaatgagagttgctggggtttttttcttttgtatctatctatagaagcatactgcatattcagttttttttttcctttttatatatggaagcatagtgtatattcagttttgcatcttgcttttttcccttaactgcattgtgagcatattcttatgctgtgtaatagcttcattaattgtctattatatagatgagttacttgaccatttctctgctgttaaatattaaggtgcttccaatacattgctgtgacacataacagtgaaacaataatctccctgtacacaaatagccaatcacatttctatttcctgagattagaattcttgggtgaaaaggcctaagtttggggtgtgtgcatgtgtgtgtgcatatgtatgagtgtataaaggtatgacagattttcactgaagtaaatgtgatggtccatttcactccatacaaggttttatactaaattgtatctcattatttaggtacagttttaaaaagtgactactgaggtagaagaatttttattcatatttgtttgccatttgtaatttctcttctgtgaattgcttaattaaatcctttgttcatgtagcttgtggagtctttgtatttttttttattatcttcttgcaggaagtctttatatgcttaggctattaccgacgggtagacgatttttggataattattataaaatgctaattcggccaggcacggtggctcacgcctgtaatcccatcactttgggaggccaaggcaggcagatcacgaggtcaggagatcgagaccatcctggctaacacagtgaaaccccatctctactaaaaatacaaaaaaattagctgggcgtggtggcaggtgcctgtattctcagctagttgagaggctgaggcaggagaatggcgtgaatccaggaggcagagcttgcagtgagcggagatcgcgctactgcactctagcctgggagacagagcgagactctgtctgtctcgaaaaaaaaaaaaagcaaattcaagaccaaatttgttggtaggctactactcccattaaaaatatatatatatattactgtatttgtcttcatatatttattcccaccaaaaaaagcagtattcattcactcagttattctataccaggcactgggtcaagcatttgagatatgataatgaacgggacacagcctgtgccctctgtgagcttagctggatatacacagcccatttcaacatgctttgcctgcgttgagcacagagccatatggaagcatgaggcaggaccacctaggccaattttggccatcaggggagctgtacccaaacaggagacatctaagcagtggtgctgggaggcagctgctgaggattttacgattttgttaaaaaaaaaaaaaaaaaaagcagcattctcaaggcttctataaagctctttctttgaaatttataactcataggcttttttttattttatttttctgttagatttacacaatgctgggcatggataatttagggagacctgaaactcagagctcaaatctatcgccttccagatgctgagaagagaaacatctgatgtcagcttcctctctgttcctaacatcttcagttccccaaacagactttgttaacagttatcatacagctatgattttaatgccgtgagatattatattaaaatgtaattttatgctttaactttgctctgcccagtttaagagtaccaagtatgtatcaggcactctgtactgtgttggatgttagatgtttctcccataaatttggatatgaccccttcctttgagatacttttagtttagtctaccagtaacccagtcacaatggcaactttataagcagcaattaaaccaactaatttctttctgaaaactcaagaatcttgctttgtggtaatgtatctgtcaaaaacatttgattgagtagaaatagaccatgactgtggaaaaatgcagtgaaaaacgtatgtacaaataaatatgttctcatgattcattaatatgatcatataaatgtagaccctaatcatattatctttgaaacttttgtggtaaaagggttgctaagtcaacttaacagtaaaatcagttgcagagtgatcattggtaaacttaagaaaaacttccaataatggcattcctttgtgaagtaactatttttatgacaattgttcatatcaaattgactaaaatagatttggatccatactggaaatacccttcatttagaaaatgtctaaaatgataaatgtgtaatagctctgaaataatctacatttcaaatttttcattttttaaaataaataatctcttttaattcccaaatagcgaattcttccacactgccctgttttattaaacaatagtggtcaaaaattattatgcataattaaataattccaaaaaaacttgctctaaaaaatgtactgctcaccaactgtattacagatttaagaatgatgagcatgttaaggtttcttggagttgctctcattttgtggaacggtaatgtagtattctttgtattacaaaaaaataaataaaaaatctcttgagaggagggtagctggtgataaatgctctgagttttcttccctggtggttgtggtgtggtagcaggatagagctacttgttctaatgtagcactcctttgattatttagccaaaacctttgtgttaagcaccaactttgtgaaacttaccggaccaggattagggatggaggagaagcacaagccacagggcatacagtcaagttacaacacaatcatggagatgagacttatgcagaggggacaatagggagcatggcaaaactgtatgttgtgtatgaaagagactaagtattgttggagtttggggaaccattagtgcagactggtatggttgatggcagtgttatgaaggagcaagaacttgactgggtgttgtagcaggaaggctggggaacagtcggagcagacatagggctgggttgtttttcctgatgcatgtgggtgcagagatgacactggccaaatcaagtaccaaatctgtattaggaaacactgggagagtggagtgatcagaagaaaagggtgagttgtataaccatggcctttaaagcctagaggagaatgtgtacctcccacagtacacgtgaacgactgaccaggagagaggcaggcagactagttaggaggctgctgccaagtcagatgatgaggcctgggcagtgatgtcctgtgtgaaaaagagcatgggcattagcagaagcagctgggatgagcctacatcctgactgggctcagagtctcatcctgtgtgaagctaattggatcccatgggcattaaatccctgaccagggcctcattagtacaagttctcctcaccagagctaaccagtgtgggtgctgatcttaataggttgctatttttgctgctggagactgaaagaagtatttagtctctatgttaccacacatagaaatagggaaaactttacaatgccttttctaccttttcttttggtaaaacatgagtagtttgagaaaatgtcatgctgttcacatttttctctccttcattatgtattaaatgatctggccttggggctgtggggtctgagatgaatgctcttaagaggatcaatttcagaagaatcccatgaaataatagatatcccttgttcacatcttaactgagcctattcagatccgaatgtgtaaaaacctgaaaacatccaaatggatttctttaaatgctaacttttagttcagacatttgccatcctgcagataatgctgctaggtctataaaactcacagtaaagtgaaaatgtggcaattattccattcatttgaatcataaaaagtcaaaacagaaaattgggattacaaagtaattttgtggcccaaatacttgggccaagtctttaattaactggccaactgccaaatttcactttactttgttctttgatgacacagccaatgagaagaaatgagtcataagaaaataggtttgggatgggacagagaattattttttgaaattaatcatttagtcattgggtttgactgggtatttctgacttaatttgaatcttattcagaatgtaattgtttgatcaaattttaatttgctttagaaagaatacatacatcaatgttaagtatgaaagtacctgatttttaaaaacagtattttaaaatggtccaatcaaattttgatttgaacttaactgatcaccttcacagcatgaggcatttaggagtttacatagcaggtgagaattgcctattgatattgcagtctgagcaattcccagctacatatgcatgagaaggaaggacaaggaacagttgcatggggtcaggatgactgtgctatctcccagactttagccatctaggaagggaactataaaaagcatgtgatgacactagttctagctccagaagggaagtgtttgcaatataaatgggtctcatgagacaacaacttcgaaaaggtagtaaatatcgcaacataagggtaaataacaataggatcaagaggagctgttaacagactcactgaagcacatggtgagaaaggtggggacaaaatggtgctgtgtcagtcaagaaatcaagggctcttttgccttgggaaaaaatgaggcagcaaagcaagctgcacccatgctaaacaaattagcacagaatggtgcttaagaatgtagactttggtgcaaggttatcagagctcaaatcttggctctaccacttactacttttgtcaccttggacacatgttaatttcaatttctccttctgtaaaatggtggtgattacagtcaacacctcacagagttgttacactgcttaaattagtaaatacatatatatgagacatatgtgtatgtgtgctccagagatgttcattaaatacagaaataaataataaattgccctgaatcaggcaaaaggcaaggaactgcaggcattgcccaataacacttttttgaccaactgatgcctgcatagctgtacctgctcaataatgtatatagttaaaaatatgttctctggccgggcgcggtggctcacacctgtaatcccagcactttgggaggccgagacaggtggatcacgaggtcaggagatcgagatcatcctggctaacagggtgaaaccccgtctctactaaaaatacaaaaaattagctgggcttggtggtgggcccctgtagtcccagctacttgggaggctgatgcaggagaatcgcctgaacctgggaggtggaggttgcagtgagccacgatcgcgccactgcactccagcctgggtgacagagcaagactccgtctcaaaaaaaaattaggataagaggaagtcaaattgtccctgtttgcagatgacatgattgtatatctagaaagccccatcgtctcagccccaaatctccttaagctgataagcaacttcagcaaagtctcaggatacaaaatcaatgtgcaaaaatcacaaacattcttatacaccaataacagacagagagacaaatcatgagtgaactcccattcacaattgcttcaaagagaataaaatacctaggaatccaacttacaagggacgtgaaggacctcttcaaggagaactacaaaccactgctcaacgaaataaaagaggatacaaagaaatggaagagcatttcatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagctcacattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaatgatgccacatatctataactatctgatctttgataaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaataaaacctaggcaataccattcaggacataggcatggacaaggacttcatgtctaaaacacccaaagcaatggcaacaaaagccaaaattgacaaatgggatctaattaaactaaagagcttctgcacagcaaaagaaactaccatcagagtgaacagccaaccagagtgaacagaatgggagaaaatttttgcaatctacttatctgacaaagggctaatatccagaatctacaaagaactcaaacaaatttataagaaaaaaacaaccccatcaacaagtgggcaaaggatatgaacagacacttctcaaaagaagatatttatgcagccaaaagacacatgaaaaaatgcatcatcatcactggccatcagagaaatgcaaatcaaaaccacaatgagataccatctcacaccagtgaatggcgatcattaaaaagtcaggaaacaacacgtcctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagcagcacacatgcacacgtatgtttattgaggcactattcacaatgacaaagacttggaaccaacccaaatgtccaacaatgatagactggattaagaaaatgtggcacatatacaccatggaatactatgcagccataaaaaatgataagttcatgtcctttgtagggacatgtatgaagctggaaaccatcattctcagcaaactatcgcaaggacaaaaaaaaacaaacactgcatgttctcactcataggtgggaattgaacaatgagaacacatggacacagtaaggggaacatcacataccggggcctgttgtggggttggggggagggaggagggatagcattaggagatatagctaatgtaaatgatgagttaatgggtgcagcacaccaacatggcacatgtatacatatgtaacaaacctgcacgttgtgcacatgtaccctaaaacttaaagtatataaaaaaagtgttctccatagggctcttttggatttggtatggtgcatacagacagtggaagagtgacataatagggagttatttgggggagaaggaaggatattcaaaatagtaaaagctttacttttgtcctcaagttacaggtataccgttgcatactgatcattttaattcaagagtcttctcttcagggtactaaatagtttactgatttaaacatatgtgtcccaaatgatcaaaaaacatcaaacattctgcagttactagaaaacatcttgcacttagtaactggagttcattactactaagtgcaggaagcaaaaactgaccgtttttgcttaaccgttaggctctgccttgtttttcttttttctttctttttttttttttttgagatggagtcttgctctgttgcccaggctggagtgcaggggtgtgatctcggctcactgcaagctccgcttcccggattcgcgccattctcctgcctcagcctcccaagtagctgggactacaggcgcctgccaccatgctcgactaatttttgtatttttagtagagacggggtttcaccgtgttagccaggatggtctcgatctcctgacctcgtgatccacctgtctcggcctcccaaagtgctgggattacaggtgtgagccaccgcgcccggcctctttttttaaaaaattgatttagcacaacagtggtttatttctcactcacatcataatatacagaggtagaactggtctccttgatggttctctaagtggtgacttgggggtccaggttccttctgggttgagacactgttgtcttaaaattgtggtccctaagtttgccacagaagaagagagaggttctgcctcttttagttaattcaaagcaaaataagaaagtgaggcaagaaatataattttgcccctactagtacccgtagtcccagagagcagcaggtatattacgacccctgcgccctggagtcaggcggttttggtttgagtcactgggtcccagggccacatgcagcttcagtatatatttgctgaacttagcaaatgaattaaaaactgatagtaacaaaacatcctgaatctgtcccttattagctgtgtactttttactgcatccattttaactttgctaattttctagtcacccttgggaatcacttcaaagaaaagactaggaggaaaaacagaatattgaccaagtacaggaaagcttggaagcactgtaaaggacaggttatttaaaagcaacaccttttaaagtggctttatggatggatggttgtctgataaatggcacaaaaagaactatacggacttcattaggaccaacagagagtaggagaggtctgtgtcacagtaatggcccctggcaaatcacatctcccagtgtccatgcccctgtgtagttccttcccatactgactcagggcttagccaagtgacttgtgatggctaatgggttatcagcaaagatgatgcaagcaaaggcttcaaaagtactagtgcattggagctttctctcttgagatgctcttctgagatcaccaaagggtaaagaagcccagaatggaagaccacgtggagcaagaggtacagcagaaccatctgctcagtgcaactgcacgagtgagcccaggcgagagcagctgaactccttagccaacccacagcatcatgagaaatattaaactgttattcttttaggtcactaaacttatggtgattatattgtgcagcaaaggtgaactaaagctgtggctctcactgtaaataaaacaaatcttgaagcttttaaaaatgcaatccaatctagaaccgcaaatctgatttacaccttaaatgctggccacatggagatacatgatagcataaaaaggggtgttctgtaggactgtcctacatgcagagaagaggcttcttcaccccccacccccaatctctgtctttcattataggaaggaactatgacctcttaactcacttcctcccttcctctctaaatagaaaaatgttagctgtctctcacaaagtcagcattctttggataaagtataatatccaagtggttccaagagaaaaggctcattattttgtaaaccactgaccatcaaataccaattatcttaggccttaatgtcactaaaatagcacttcagagggaatggaaatggctttttatttgactatatgatggtaattctctttttggttgacagaaggaaaaatacttaaagttgaaataatacttgatctaaagaaactaaaattctaagcaaccgatccaatgaacagagcccccgggggcagggttcaaaggaagcaggagcactgataattggggatttatcactgcttgaagaggggcactgataaagttcaggctggcgatccagcactaacgttcccttggctgcctggtcacagtggctctagtcttcctcagtgctgcttagctgcttagcaataccagctcagtgtgaatcagacaagtcactggaaaaaaaatggctcattcagagcctcttgcaattggtaattccacacagaatgggctagcatctttgccctaaaggaattcatgttcttagtatagtttcatgttattgctgggctgaccccttccctaaggcttttcatgtgaagaggaaaattaaaactttatgatttaaagcattccatattttaaagatatgtgcatgtaatcataagcttcatttccagtcattctctcttactagcaaaggagggtccttttattatgaacacaatgaagaagaaaacagcctgcccaatcacatcctttttatagccttagcagaggccatttgctatttcagttgatcctaaaaagtgatgtattcatcatgaaaaatctgagggaagcttgatgaactataacagcaaacagcatctgttaccacaaaaaatttgctcagacactaaagatactgtttactttccagcttcttgagacctctacaccaaccagtggaagtggatgcaactttctgactgtaggaatgtacattattgataggaaattctggaaggaggacacagagcaagagtggaagcataactgtatttcagtgacctttgtaatgccaaagaggcaacttcctcgtaagagctagttcttctataactgccaagctagagaagctctgaagatggtcactatttccatggtaattgctttgtaatgtctcaatggttcccagggcatgtttcttgacctgatgctaaaaatcacctcgaaatgggccataacaggtcattttgttctgctgactctaaactgatctctgaagtaatgctttagggcattgcaaccagatccatatttgcaaattttactctcagattttaaaaactgtccgctaaggtacatctgattggtttctgggttgccccattaattaatttattcatgagccccccactgaatactgatttctctgaaaagctactgaagaaataaaaggcatgtgttctggaccatcaacgtttatagtgcacatggaaagtcaacctgcctctgaagagaaaaaagaacacaggcatttctaggaaagcaataatgacaatggtgggtaggagtttcttcttttaccataaccaccttcctttcttaccttgctctgatgggttgagatcctagtctgggtcccagagcactaccattcccaggagaattctttctggctaatgctggggatatagaagttgttctttgaggcacctggaagaaaccagaattcagaaatattttccataaagtagcttccatagcctgttgtcagaaaatcctcctttccaatgatttgccagaagccacagaaactatccgaaacagtaaagaactatctttcattcattcctcgaagaaatattaaactccctaaacaaaatcaaacaaaggtctactggcaaaaaacaatgagcaaatttgggaaccattaaagagggtcatcctcaatcttaaaaacaaatttaaagataggtaaagctaataattttgatacactgagctaaaaataattgacctctcttggttgggcaaaagtggtaaataccaggaatttctttagggtatcattaactcattggaagttgcatcagctgagagccacccagatgaagcaagttccacttttagcttacatcacaataaacagataaggaaatcatgaaatctggtgagaaactagaatatcaggatagagcttaagacataagtcatatgttggtgagctcagagaacctaccacagtagatcttgaatgtttctactttctaattgatttgcaattacctactaaaaccaaaaaccaaaagcactgtgtcttggtcaattagtgaacataatagaacataatacaaagcagaattaatactgaaaatactggaaggatcttcaaaaaggctgtgtaagtaccaataagacttgaggaaaatgtattattagcttatctggcagaaacctaaggtagaattgaagtatgtcccaatttataaaacagacattttaaaatgaaattaaatattttaagtgtaccaaaggagtccgttatttaaaagaatcatattatgaatcctagtatagaaaattactttcagtgtaaagtgtcatcctttgttttgaaaatttaatttttattattcattttaacataaagatgagtcagtaaagtaaagcagaatgaccaaatcaatgctactacctgttcaaattaattattactattttttcttttccttaccataaatgtacatagttgtagagacagaagagcctaacgaattcttaaaacctaagtttttgaattcatctaaaattttctcccaggttcatgcatgtatgcctgcgtatttttagagagtggaccaataaattcagttttcagcttttccatctattgtgtctgctcctttgcccactttatttttcatattgacttttgctccctatgtacccttttttttctgatggcatttctgcttccacaaagaatctcaaaaaattatcagctttttttattttcaaaataatgggactcttgttataatatccttttaagaggaagatgaggaaatgtatttgtaattgagtaaaagcttctttttcttctggaattaacagtggcattttctgcaaattgtggaacattccatttgtcacagcctctatgctaatctcaggaaaagggggattcctgagccaggaagaatccgatgcaaaaaatgtctctagtattttgaaatacttccaggttgtttgtagctagatgcacacagccacattctagaacatttcttggaatgagtaatgacttggtataggaaaacaaaagaacccaaactcagggctgttctgtccagtggaatggctggtcattttaccctaaggtttttcctcagtagttaattaaagatggaaataaattatgacttggcctagaaagagctttccttaaaatggggccaactaaaatatcctaagaacaatactatcttctgaacccctgaaatctggcttcacttttgtgttgttaaaaataggaatacatggattttctactttttatctggaagttttcaattgtcttgatgtagattcagtcatcaatgaaatatccattactttatttgttaatatggatagcaaaatgacagtttggaatacttggtgttgagagttctaactttggacgtaggatctgtgcttcaatctacctgacttcagttttcttgcgggggaaataaaggtcagacatggtaaatggcaatccaagtcttagccagggaatgaagagggaccaaaacaaacatgagaaggggaagtgctttggcatgatcacattctccactactacgaaaggtctggaatagtggtaataaaaatcatcagtgatgctggtgattaaaaaaaacaccccagtaaatattacctttggtggaatgtcttcttcctgtcgtaaccaagagcttcggtcaaacttttcaatgcgagtggggagaggaggattttccgaggtgggatctgagttctggcgtggcatctccacgcggtgggaggtcacgttcagagcctcctgaaacccagagaggccctttgtgggctgctcgtgcactgactgggaggcggtcaaggcaggtccctgggattttacagctaccagatgtgggatctaagcatcaaaacaacatgaaaacagcactattagaagaaaaaagagatcagccagtacctcagtgagctgaaggaaaaaaaaaaaaaagttcaagggcacaaaaattggactatagagagtctatcacaactatatatagcatgttttttaacagctcttcaaaattttccattggaacgatatgtagggttggcacaaagttaaatgatttacttgggaacgctaagtcagtggaatgtgtgaaataataacaataactactgtatatttagtgaatatttattgaccagcaatgcaatgtattttataagcacttctctgctaatattatgaaattcctcctttaaaacccctaacttttacattagagggtgttgctctgtaaaacaaaaactgctctaaatatcttacttgttatgaactcactgagtccatcctgaggtggatacagtcatttccctcattttacaccggagcaatgtaaggtgtagagaggtttagcaataccctagattgcacagataacacctgctggagcatggactggaccaggcattctacacccatagctcataaacctaacctctatgatattctactttctcctgtgctggctcttaccatctatgctgtcgtattatctcttgacaccaggatgtaactttttgagttaagtatctcaactaggccaactgggcatgtggtgatactgttcacgcagggaagacaggcagtctttcagcgaagttgtggctcttaaagacaaatcattaaaatccagagtgcagggcaccactttgccatagcactgctcacacctcatagttagtgcttatctaagcgtgtctcctattacttcacgaaggtgagctccctagagagaggcactatgtctgtcatgctcatcgtcatatcccctaggctagctctgtgcctggcatggggaaggtgtcccataaatcctggttggggaaaaaatctacagtgccttctaaattacactgttaattcaacaaacattagtttaatatctgttttgtgcaaggacctgtcaaatcctctttggttttaaatttaagtgctggaatgttattaatgacagttcagaggaaatcttcaaagcccagtttagctgaatgttaagcttcaaccagaatagaacctactggatttatattaatgttaaatatcattaaataaataataatattaaaacaaagcccatttaaaaaaatatctagtataaaacacaaacccactttaaaagagccaaaaaataaaaaaataaaaaaaaccacaccacacaacccccaaactgaagcacctgaagaaagcttaagtgaattaactgtcacaaaatatctacattttcactctggttgttctcatcaagtacattttccctctcttctccccttttaaaggccaaagtaccttccaaggtcaacgttaggggttttaaaagaggatatttgtacattaaaatagaaattcctgtaaaaaaatgtatctttttgagggttaggcatgaaagaattatatacaaattaaaaacagccaagaggaagatatgccaagctgcctggtgctgaaaaatcttggactttatttactaaaggcaaactgaaaacacaaagaatacttgattttatcactactcttttaaactccagttcaaacagcattacatatttcaaaggtgaccttaaaatatttcgtggaagtcttaacacaggtggatgcctggaagaaatttaagacatttggcagaagaaactacattatttttcatggaattccttaatctatttcacttcatatttcatttttggcatatataacttaaaagtcctgcagaacttccagaaaccccctcctttcctaaaagtggagtaatcttttttctttaccctatagcttttaatagttgttctcaaactctaaagtacattagaatcacttagaggtcttgttaaatcacagactgccaggcctcccccacccccagagttgctgatcagttggtctgaagtgggcccaataatctgcatttctatcaagttcctgggtgatggttgatgctgctggtccagtgatttacactttgagaaccactggcttagaagacgtaattttacttaaccaagtctatttaattttttcagtttcaggctcatgccaaagtcccaagaaaacaaaaaatatataatgcacacacatacacacacctcaaagtttctatgaattctagttttggcaattgcaactaaaagaatgcttgttctcaccttgcaggaactcctatgggtccccagagaggccaatttaaatagaagtgagtttgtggttgactcaagtttaagggtgatgcttttttctttctcacctgttcttctactcttaaaaatcagtggggccacctattttactataaattctatattaagggtcataatttgatcctgtgcctgaatccatgttacaattccctaggcttttaataataggttttcttgtgcaacttattggaatgcctgatggaatggaggcagactgtacctggggatcgactggtctgagcatggggggtgttcgagcaggctgaactccactaatgctgaaggactccgaccttgggggcaggttggggtcagatatcctgttggcaaccttgtgaggcatggcaggggaactttgccggttgagccttgaccgttcttctacctacaacccaaaaaaaaaaaaaaaaaaaagacagcctcaatgtatagaagtagatcaccttctagcaaggattttctgtagtcacctgcacagccatttgaatcctctgatcaactgattttaagaagacaaaactctgtgctgcatcaagagtttgcaaagagcaaacactagcaacagcaacaacaaaatagaacacccaagccatcactcttccattacccattatctagtgttattcggttagcagggaattcgtgacctgctaagagtttatcttgtattgattgtgatattatcttactgattggtcgcaatgccatggggtcagtgaggaagacagtttgcactctagacaatcaaagggaatggtagcatgcatttagatggcttggggaacatagaaaattgctttgggttgactcatggaacatgagaggaagaacaagaggatgaagctgagtgcatgcaccctgcatttcttcacgtgtcctactgatagacaagtgggtgttccaggctgcctgcttaatgcgcgtggcgtgtttcaaataggcttcctgtatcactttctttttctctctttaggggtctttctttccagttgtctttcctgcttcctcaaatacactgccccatctcattctttcatgtccagcttggactccactgtcttgctctcccctttcttcctccctgtttctacacatgtggtgttcattcttgcttctcctcctttctcttcccctctaaccctgtcttctctcaggctgtttcatttccttgtcattccctttcttccagggtctctttcagcccaaagcagataacagatcccaagggcttcacgggaaatgctgagccagtgaatgccctttctaaacaggtcatcattacctttagtacatatttacagcagaaagactgcctcggagggcaattttaaagagaaacttagataaacaaggtgcgcactctaagatatggcttaagatcttagacaacttcaagaagcctatgacttttcttccagatctactgtgtcctgtcctttatttcttcaggaccaacttgactgttgtgcttcccaaagccaccaggacaatgcaaccattctccccacactgatggcctttacagtgagcccttaattctcttctgctgactcactgagcattttaagaacccacgtgcagatgttcaatattcatgtctgtttgcatattttttatgtagcagctaaaagtctttattcattttactgcctgatttgaaataaaaacttgaaagagctattttcccccatcctccctatcccattttgaatctttctagaggcagactcaatcaaatatacaaagtaagtctgtttttaaactcatactaacctcacatattttaacacaataagataagctacagaatgaaaaacagccctcctgcctctagtgaggagtaatttgaacatctcttcccccaccatggctgtgcagggtacatacaattggctttggttttgaaatcccgtgtcccagaagcttaccacacaccaaatgagatttgctgcaaaaagccaggaatataaaccagaacatgtgtactttgtgtgtgcatgtgtgcgaagtattacatcagcaataattatttggctattgcattgagcaaaagaacaaagccagctttgagataagaccacaaagaagaaaaagtcccacaaagacagcaatagataaactgagatcaaggcatgcaatatatcacttttccaaatgccagactctttgaaagaaggttaatatttctagaccactggaattggtcaaatattatccattttcttattttcagggtagatcattaatagataagtcatacataagcatccttcagtgtctgaattcccactatccaaaccacttgtcacccaaaattcaggaacaaaatatatgcagagtgaggaatacttgtaattattatttttggctctaaaatacactgatagctttaaatgtacattaagggacagcacattaaaaacaatagtagaaaagtttgcccccaaagactctatcttgggcaaagaaaccatttttgagataaagaaagaattcttttgggaagtgtcagcaacaaggccccagtctaagcatccctgctgctaataggatcacaggccacagggggccctaaagctatcattagaaattaacagggcattgggaggccgaggcgggcggatcacgaggtcaggagatcgagaccatcctggctaacacggtgaaaccccgtctctactaaaaatacaaaaaattagccgggcgtggtagcgggcgccggtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaagaaatgaacagggcagaaactagggtactggttttcacaggcaatgaatggatttgattagtcatgtatagatgttgctaatgtacttctagtaaaaatttcttatgctttctaacagtttacatattaaattctatcattagtatatttcagtcggtaccattctaaaaatatatggcataagtaattgttacactttgaaaattatttcaggaaggctccagtgtactgaaatttcctgggttgaagtttgtccaaagaaaattgaaaatctaagaaaagggtgtaacgatgaggcatctcattacgtactttgtctcaagaaaacctagtcctgaagtctttaggaagataatgccgcccaagtgtctttacactgcagaatcaccttaagaactggagcaaaggatcaaatcaaacattggaagtggcacttctcctaataataccttcagatggacagagagaaagctggatggggtatctaggcaggcccttttcattattttcatactagacaaaggcctgttccctggtttatcacaacttatgtctgctgactgaacaggagataaatatgtgagacaaaaaaagaaagtctccctccaaaacctctcccatctagaagaaagatacatgtgattaaaaactgggaacaacaagatatgtttcaatgcctgaggatgttcaaaaaagtctaggagccaagtttctgctccaactgcctgcttccaagaagacataaaatgccaggagcaccaattagaaagtgttccagtaccatcaggtatggagtgtgaaggtgctagaccataacaacaaaagatacctgttataaatgatttcacagtagaaggaattatcagaaatacagagaaggttagcacagactgatcaacttcactataaaagtatttttttcttattaaaaaatcgtttcaacatgaaaactaaaataactttggagaagtttggatcacctctgcaaaaatgctatactatttactatagcattatatagagagaaaaaaaataactgtggtctcagaaataaaattctgctctagacaggtctgtgttatccactgcctaggataggagtaatgtctatggcctctgctatatataaaggctatacaaatatagacaacttaaaaataaatttgttaatttcaggatttccaaaacaatttcaaaataaattttttaaaaagttaaaacataataaagagaaacactgtatcaatgtcaattgtcaaattgttttttatattttaaaacaatttgtaggttacagtgtctcactttacaataatgaataacatctactgagaatttcaaaacatttatagaagtaattttaaaactgttgacagcaaatatatatttactatgtcatatgggtgcattctaataatattttataatatgtagagtccacggggtttaggaaggtctcagaaggctttacttaagaattaatacatggtgaattcaacacaatcatatgggtattctctttttttccccaactggacaaaacagtttggtttttgtgtttattggcaatgctggagaaagagaaagaagccagtaagtaacttttaagtgctccttagatactttgaccctgtactcactagtcacataaagagctgagtaatatcgttgggcaaaaccacatgggcagatggttactgagcaagtttgaggatgcccctgctccgggtcacctctgagaacgggggagactctcattcataaggaatgcttaagatgcaatcttgtctgactctaagggcctggactattttcccagatcaacttcttactaatattccagaaaaacgtatagatccctgtgtgaatggagcacatacttaaaagtaatgaagcaaaatcttagaaagttgatataggaaataaagaagtgcttatctatcacctgggagaggtgggtgaagagataggcgacgccagtgaattggtcatatgaaatccagaccaaaacaagagacagaacacttgttcctcatgagctacaacagtcttggaaacaaaataggaatatgttgaataccatatttcatttgaatttgtgtagtatgtaactttaaatggcacgtgcatattcattattgcccatgagcttcccaattgtgaggcagatgtgcggatgaggaagctgcatctcaggaaggcaggagacacgccctaggtcaggcaggcaggaagtggaagaacttgaactcaaacatactccttactatttccttccaggtctctcctatatttaatcataagagagatatgcagaaatggaggaaagatataaactctctaaatgctagtttgggaactttatatataaactaactaatataaaaggaaaaagaaatcacttaggtatagagcagagaaatccggatggagaaggagtttttatacacagtgatttcaaagtccagtgaactaatggaaataaagagatattttggcccttatcagattgatgtttgcaaacaaacactccaggactggcatatatcacagaaagagaacacgatggagtgctaaaaaaattaaaatacaatctcatgcaatactcatgtaaacaaagcattctttcactgctgagctttggtacaattttttttttaagtatgtgggatggaaaaggaaggggagcccacacagttattgccaggcccagaaaatcacatgccatttaaggagcagaagaaagaaaaaggaatctccatcatccaaaaagtgaggaagaagaccttcaaattctgccgatgttcaacagaacatcatactgatattttcacagtacatacctgacatccatctcaactcagaaatggcagataatttgaaagcagtgagaatgcccccaacctgtctatttatttatgtatttatttgaaacagggtctcactctttgcccaggctggagtgcagtggtgcaatcatgactcactgcagtctcaacctcccaggctcaagtcccaccctcagcctttggtgtagctgggaccataggcatgcaccaccatgcccagctaatttttattattatctgtagagacacggtttcactgtgttgcccaggctggtctctaactactcctgggttccagagatcctcctgcttttgcctcccaaagtgctgggattatagacgtgagccaccgtgcctggctccaagctgtctttttaatgcagagacattcatattcttttaaatcaaggccaatgtgacatccaggacagaaagaatactcagtaaaaggagggagagaagagctcaacaagatttgcaaatgactgagcattttcacttgctctacaatatccaacatattaatcagaaaggtactcagaaatgcagtgatcacttgtgttttacaaaatgaagaaacaagaacagagagaacaaagcagtataagagcattacattgctgataaaggactatcgatttggaatgaggaagaggagaagtagatggaaaagtaagcaaagaagaagaaaaaaaaacttgatgagacggcatagagctgagttacaaaacaaatgctggaacagattacagaagaggttgcagtaggtggaagagagctaggtgataccttcagtggcacatggggcaaaatagtccagaccctacacaacaggagacggtggcatgggcacagagggtgcatttgaaaaaaagaaaatggcatccttttattttacttccagagggtttaacccaggttttcttataacttgatagttaagatactgataagctatgttcatatttaaagttttgaaacgtgtattactacttggtcactttgagcccctgccttcctaatatgagaaaagacatctgtaaataatgctttacataaaaagttcatacactgctgatgagaagcattaaaagatcaagaatgtaaagatccttgcactgatttttattcctactaagaagtgggtgttaaaaatgatgactcaaaccaaggcagacaattatttgttcttatttgtacatcgattgctccagtcctaaatttagcactgtcactctccttctatcaactaaatgtttcatctttcttctaaaatatgatcacccactctaagacttgggaactgtttcatgaacagacaacggttagttggaagctggattatgttaaccacacccaggagcagaggactaaatatgaaatccccaaagaatgttcccatatatctgtggaaatgcgtgaagcccaaaggaagcacaccagatgccaggaagccagggaccttggaagatgtcacccaccagagatggcccagacttatggtgactgggaaacctcacatcaggagtgcttgatgactcaggcatgttgtttgcatgctcaaatgctgtgtttcttttactgctaggagcctgaccaggaagcatgagggaattaagaggtctagaaaagtgccttgatgacatctgcaaagatctgcccccaggaatgccatgtctcctgaaagcttgggagctatgaactagttctgaatagagaggacagaccagtaaatttagtgatgaggacaaatagcaactggaaaacagtgaagtcaaggtagacaagttcaaatcacaaggtgctgggtagaggctgaatgaaggaggtgaaaactgtttcatgcttttccccctcttctggtacatttgtgcatgagggagctgtctaggggaaagaagaaattctggaatggtttgcacaacataatgatcttttccaatgggatctgtaggtgtccctctcctaaactcatgcttggggctgggaacactgaaagccaagtggtcatgcatcaaggggaggtcgcttagcgatgcagcatttcttagaaaagtagaagcacttgtaaagatgcatgagttcatgctcttcctgccccaaggtctacatgaatctctaaggccctcctgaattgcagtaatggacaactcggggcttgtcactttggagacgttgggagaagacacacaaatgaccttagatcctaactctcgagttgggctacatccttgggagtgagagtgccttggagatctcactatggtcctcaagacttcctgaggcttcatttgttcttccaaaccaagtctaataggacaagctcgtccatctttctcccatgggtgatgctcaagcaggagtcttggtctggaatcattaattcctgcaggtgctactgacattagctttgtagaggctagtttttcagtggtctgaacacctgccatggtcaggagctgtgggtctggcttagctgaggatttcaacttggcatggctaggaaatggtttagcagtagaggaaggtggtgcatgcctgccagccaagaagcatgtcagctgctgtttagcagcatagtgattttgcttagctggaagaacaggtggattattaaggggtcgatgctgtacctgggagtaggatcacaaaattgaattactgatctaagagaaagaggcagatgttagagacataggtaaatatggatcatgtttacagatgtaagggaaagtgataaaaaattcttcatcacaaatcaaaacaatttttccacacacttagtttaacttttaaaagaaaaaagttattttcacaaaaaaatacatgatcactctaaaggatttaaacaatatgtaaaagtacaaaaaagtttttaaaaatcctttttttttttttttttttttttttactttctgctcccataaaccactatcattaacattaggacaacattatgtcaagtattttctgtacatatgtcagataggttagacaaatacaaagaattattttcataaaaataggatcttatgtaagaaatctggttctagtaatattgcattctagataacttgaaaaaagcgtgagctatcaatatctaaagattctagataaaaatacaaaataactccaaaacatccttttaaatgaccagctatgatcaccataaaataaaggaaatcactagatgccagaaataatgattgaactgaaaaccagcgtgttatgcacatgacctcacacagtgactccctggaaaggttgctgatttggttggggttattttgtttgtttgctttacctgtctggctatcacccttttttccctcccatccaagcagtttttattaaaatagctcaacatagtgctaagttcctgaaaatcctttcttagtctagtagttaagcaaatgaaggaagtatgtgtagaagaaacactaatgacctctgatcttaaaagtgaataccaccaccacaagtctgaggtcaactgtgcatctgctggtagtatcacagtgaacaaagttatgttagtgacaatgttaatgatcagcaacagggtccaggcatggacaggaactgattcttcctagaattctataaatccttaatcacattattcaacaaaaaggtcactaaaaatcctccatgccacaaattcaattggatgagtaacagaaaaaaggttttttctatcttctgttatttcctataaaagtccattgcaaccacaaagatatacaaaaaaaaaaaaaaaacaaaaacaaaacctcacaaatgaaggaaggtatcttgccatttctctacagaaataatgttatagttcttgcaaaagcaaagcatgtgtcttatgatgaattgttttccaactttgcagcactgggttaactctccacttctatcacacaaactcattagagtcaaaagcctggccaacagggtgaggctacccttgcttacttacctccttggcccatgctggcttctcactaggactcattccttctttgtaatggtacagtggcttcttctccacaggcctctgctcctgccgctgatgctgaagggaaactaagtagtctctttcttgctttagctgcctctgcagtctttctgcttgtctctgttcttccaattgtttgcgcttatattcctgtccagatcaggaaagaggagcaaagaaaaggccaaattatcacatagaaatcatcggccagtaccagataagcatgcaatggaggcaaaataatgctaaataacaaaggatcttaataccaacagaatgacagaaggatgtcaggatgtgccacagaaataagctactgccttgtgttagtatctacacaagaatgtgtcatttaatgaaaacgctattgctttaaaatggcaatccctaccgaaccccatcaattacaaaatgacttgtccctgatgaattacaagtgacaaaatggcaataatgaggacatttaaatggtcggcatacaactcctagaaaaagtcacccacttcctgatctagtaattaaaccactcaaacatgtacaattaagtacaaactaagcagccaaagatagtgcctaaatcatctttcatttaataaaacttggacctacaaaggccattagcaagcttatgtacaggctaaaaaacatcagaatgccattaaataaaaagttcagttttaaaaaatacaccaaaaagcccatctggagagcagtgctataataataaaaaagtactgtacttcaagtggaagctgcatgagcaagggacacaaaatgttcccatcgtaagggtaaagctaatagtctgtaaatgaaatatgactgtagagctgatgggttcttatgggagaggtgcattttgctgtgattgtattccagcatgtcgcaaatggccttaaaaattactctgcaataaacacagtaggtctcaaaagcagtttgtacttataataaggctggatttatattcaagttgtacaaataaatggagttaataaagaatgcataacaactgtattaaatatattaggactcagcaaaatcaatcagaaaatgtattaagtttctatgaggtttttgaggtccctgaggcttagaagatcccctcttctggactggtatgttagaaggacacacgcacgcgcgcacacacacacacacacacacacacacacacacacaaacacttgcaagatgaacacagagcaggtcagctggttcttggctttctcattaccagaagtagagcttgttcatgcagtagctgctgctgcaagatctctaactgtctctgctcctcctctaactgtcgcctgatgtattcctggagaggtaggcagcagagaattcagaggaacagaaagaaagagagaaatgaaccagtaatttcaaaggcgacaagagccgctaagtaaagtgtagaaggaaggaggggaaaaatacccaaataccttcttacaaagcaggaagagtatgtcacatggaagcaaatgcatttcaacataatgaaaagcacaagcccctctacctgcaacagctgactgcgatgtctcggcattttactgctactacttggttttaataagcccagctacatgttaaagcttttcattacaggttcctctctttatggactacctggaattaacaatgctataaagttcagaggctcctgtgcaagcagcaggaataagacaactgttgaatgccatcgtgcactgtctttgtaatggaaccatcctgcagagtttcactatgctgtaagaatgtgattctagcaaagagagatgggcctgcatcaatgactcaaagtcataaagaccagagatggcatgagtagaaaagctcttctgaagcagtgaaagagtgggacttggctgatttttcatgcttcagtgctaccttcaaatcagataccgagggttgggagaatcggaagatccgggtatgtcagggaactctgtctgggtagaaagcaaggctgaataggtgggcattgccaaggttgtacatttgacttcttgaataggtgagcataattgcttgaggaagagtaaaaacccatgtaaactgagcattcctcagaaaaggtgacccacaccccagagaaggctggtgctggggtccccggggggccatcagtggggctcctggtcccagctgtacctgttcatgctccgcacgcctcctctcctcctcccggcgcatctgctcctcatagtgccggcgctgctccctctcctgctgcttccgcagctccttctctcgcctttgttgctgtggggcaacaagcagacaaccatgaaggcaacaggccccggtggggggtgtcagggagccagcaggaaaagctgttgaaccccagacatgaacttttaatgagatatgcctaaatgctccaaggttcttctctccggggctgttggagggtacactggcagggagcgggtgagagagagagattcagtgtcacgcataacatacttccatttaccatgtaagtagactctcaccaagacgttcctgttaagtgtgttctccccacagctggtgagggttttcaagtcaggcgtagaaaacaccaatgcaaaacaggttatttattacatatcatcaagttgtttatgaaattacttcacaatgcttaagtcattcaatctgtttaacaccatgtaacacaaaaatttcatagatatgtaaaaatcagagcggtgaagtgacatattcaaagccatacagaattgatggcagagggtgctttaggatttactgactcccacctagtctgctaccttttctcatatatcatgctgcctgtctgtgttttctggagtattcattattaagtgtcaatttcaagttcttgctcgaataagacccttatgcttgggagccatcatcatcatcatcgtcatcgtcaatcatcgtcatcacctcatacaattaccatgcctccaacagtggacagtgtgataaacagcttacatgctttatttcatttcatcttcacaaaaataagtggatgtcactattatctccattttatctgagaaaactgaggtacggagagattaagtaattgttcaaggtcacacccagtaaatggcagagcttgatttcatagccagacgatgtgactccagcatctgagctcaatcattaaggaagtccaagaagccagaggaatgatagaaagatcacaaagtatctggctcttcattatactctcaggaaaggagaacattttagaagttagaactaggccaagcagttacaggagccagtggttctcaagtaggagcagtgccattacccctctctggagcatttgcaactatctaaggacatgtgaggagtatttttgctggttctgatgactgaggagcatgactggcatttaccatgagaggctagtgatgccaaacatcctgtgcaaggcacaggattgtcacatattaccaagtcttttcccatacatcatggcattagtgcaccttttgagagaggcggctggccctttgtgtcagatcctttattggctttgggatttctttttcctcatatatgaagttcagaggggacataccagggggaccatttccttgtcacattctcaacaagacttcattgcatagcttaggaaacatgaggtacccagagtggaataaattgtgactgtctcacactgataagttagctctacacaaccagggagatagttttttacacaagttctgtgtctcagccccagctaaaccaaccacagatattcagaatgccagagaagcccatgtggaaaccttcccgatggagctcctgcagcaatcctccggacctgctgtcttccaataacctctgagtcttgggagataagctgcgtctcttaagactcagtttctgtcacttccagatcaacaatgatttttccatcttggattgcaggcgaaggagagctattggaggacttcatgcagccaaatgacttgatcagacttgcattttcaaaaggcctccccatcatccatgaaaaggggcaagactagaagctgaaaagcagtgcaaggccattctgtggatctaggtataaaatgatagggcatcgatgatttcagcaaaggcgggatgagagtccatgtttataatcactgctgaggatggagacacagccaagaggaataaagactaacaactatacaggttgctggtcattctaataggacttcagtggacaccaatttagaaacagaaattagaattaggccaaaataaaataggcaggatttggtgacgacaggttgtaggagggcaggtgaagtccccggccaaggggcacagtggacgatgggatagagaagagcaggaaaagtaggagtggggtgggtaccagcatgaggcaagtcccagacatgcaagtatttgttttacagaaaaataatacaggaagatgcgagtagaaaacatcagcataggcactgactgaataatttggattacagacccaaaacagagacatttccaatactcaaccaaagtgaatcagtgccagcacagagaataaaataattatgtgtacagatctggatcctggcaggaaatagcactaatttagctaatatttcaaatttcttactccaaccatccgtctctttcttaaggaaaggaaaataatcaagccctttgaagagttagctgatctttatgtgaaggatttgtacattttgaacccctttgccaggaatcaatactgttttataattacatgccactcaggtccctgtgcaaggtgtatacagtattgattgcaactcaagagcgtctgggcttcccaagtactctgtagtttctgagaaagacactcaaaagtaactaataattaataatgatctcactcggatcagcagccgctaacacatggaggcatctgccagggctttggttcctgtggtgaggttggaaaaataaatcgctttcccaaccttctgagggcaccctgccaatttccagctgctgtgtctcaatgttaatgccattcttgaaaaaatatttgctttctctcctcctgtgcatggagccgtatgagggaggggatataaaaaaaacatatcaatgcaagaccaagtccctggcctcaggcagacacctttacaaagctctgatgactcttgctagaagcagctctctgagggcaaggccagtgcttgatttctgctgtaccccaacccctcagacgggggcctggcacctggcaggtgcacctaagagtttgttgcgctgaacatagtaagaaacttgagggaaaagacaacacagtatcctcttaaatttctttgtagaatttttcctcctgtcaatactgacggtatggctacctttccataccttatagtatggctatttgagtatatcttaccaactttgcaatctagattgaaagccgtgtgtgggcaagatctctgttccacttgtttttatctcccattgtttccatatcaggccagccaccagtgatatttgttgtgttgaatactgcaaactggctaagtaatagaagaggggagagccctgcagagctttgtaccagacctttactctttgatgcccttcttaagtagctcttattggctggaacattcttttatattgaacacagacagaactggagaatgttcttctaaaaagagccacctacagttggcactggaatgtacctgtttgccatcttagagaaaggcatgaaaaataagggaataagagtctaaactggaaaaaaagggaaaggggagaatcaaatagcattcctagatcttattcaaattatacataatgaagatagtggtcctgctatcagaaaagaatggctgaaaccaactactctaaaactgttggcagattctccacctatattgaactgcctagaagtatattttcatccatgtcttcttgtaggcattgctaaaagttatattccttaaaattggacattcagttgcttcttataagtttcttaattttttttccggtggggagatgatggatagaacctactgttaaagttttccaggccctaacaattgttgccttactctatggagtagataatcagggacttcatgtcccttttgtcttctgttgatgttcgccaaggatgatttctttttaggacaattcctttttatttttattttaagatattttaaatttcttattttagacattagagaaaggcatgaaatatttaaaagttcttattttaaatatttatgattgacatgtaataattggacatatttatggggtacaatgtgatgtttacatacatgtataaattatgtaatgatcaagtcagtgtaattagcatatctaccatcttaaacacttaccattgctttgtgacgagagtattcaaaaaccttttatagctattttgaaatatgtaatacattgtgaatttcagccatcctcttatgcaatagaacaccagcacttattcctctcgtctatagctttgcacccattgaccagtctctcaccactgccccctgccaatcctctggtaaccactgttctactctttctttctatgagagtgacatcttagattccaccagtgagtgagatcatatggtatttgtctttctgtgcctggaatctttcacttgatataatgtcttccaggttcatctacgttgctgcaaacaacagaatctcacttttttatggatgaatagtacttcattgtatgtaagtaccacattttctttattcacgcatccactgatggacacttgggttcattccatatctggtctattgtgaatagtgctgcaataaacaaaggagcacagctatctctctcttttttttttttttttgagatggagtcttgctctgtcgcccaggctggagtacagtggtgcaatctcagctcgcttcaagctccacctcccgggttcacgccattctcctgcctcagcctcccgagtagctgggactacaggcgcccgccaccacgcctggctaattttttggatttttagtagagacggggtatcaccgtgttagccaggatggtctcgatctcctgacctcatgatccgcccgcctcggcctcccaaagtgctgggattacaggtgtgagccaccgcacccggccacagctatctcttgaacacacagacttcccttcctctggctatacacccagtggtgggattgctggatctggggatctattgggggcagttttgatcctccctatgaatgctcccctcacgctacctctaggtggaggctgtgtggctgcactttcaagcatgtgaatttgttagttaattttaatgagggaatagtaattttgtcccacctgttcagggggccctcaaaggtaatgcatttatcccaaattggctatgtagaatttttgctgtttaaattctttgcagagaatatcacctcaacccttaaattctgaattgtcattagaggtctagttttaagagataatcctcatgcatattcctcacaagggctgtggagtcagtctttcctttttttttttttttttgtttaaatgctcttcttagattactttagataagcagaaaagtacgcacctacaccagggtgttctagctctcatagaagtgactttgatgaactgcaatgccataaaattgcattttatgatgtcttcaaaatagctgaataaagctaaccactgcatttatgccaggaatattgcctcagacattattcattgcactacttactaggcaagtgtatagttttcagtgtgatctcagaaagcttgtctgagtaactggtttactcttatctgatggacaacatgaatctcaaccacttcacatctgtctcttttctcatgtgtcaggcctcagagcagattggtgaccgccctgggcaacagcgctggatgccatgttgtgcaggcattctgtgcactgaccccgctcctgcctgcatcttctttctccgttctactttatgttcccttctacattgtcttcttgtttattttacttttaattgctgtattaatctctttaagccaccttaactcctccttttggaatgaggaaaagtcataataagccaaaaaatgagaaacaaatcttggccctggtccatcttttatatacatcatatttcccattatatggacccaagtgatatccacatctgagaattaatatcctatagctgcaatgcaacgtgtcattgggatagaggggtaggcaagagaggcaacagggcttggggaaagaataaaatggtttggaaacagactagattctggtcctgcactgccaccaatacgaacactgaagaccacgtagcagcgctctgtaaatatgtgtttgatggccgggctcacacctgtaatcccagcactctgggaggccaaggcgagcggatcacctgaggtcaggagtttgacaccagcctggccaacatggtgaaaacccgtctctactaaaaatacaaaaattagctgggtgtgatggtgcgtgcctctaatcccagctactcaggaggctgaggcaggagaattgcttgaacccaggaggcggaggttgcagtgagctgagatcgtgccactgtacgagattgtgcctgggtgacagagtgagacttcatctcaaaaaaaaaaaaaaaaaaaagtgacgaatgagtgaatgttgtttgaccttgagtaagtcaccttcagctaaactttcaatgagggtatagattaagtaatcttgcaaatctgttcattctaagagtctgagcaaggttatgctacattgcaaagcaaaaatctaaccattcagagtgaaacgaagcagaattcttatttgcccttggagagctcctgttgcttttcatcttgggtgacctcctgaaagcggtgagaggaaaccctactgtgactgtggaagacccgagttggcctccagaggacaggaaaacggctggtgcaagatcaagtcaggctccttgggaagtacctcaaaccatcccctccacccaggggctctctgttcaaagacactcagaatgaaaggacccagtgtggtcttttgaattgactgcacatcacacatgccccctcactttaaataggaccattctgtataagcttcacgggagctatacttgtgatgagaggtattccagcttctgggcattccattttcccatttaacgttgctaaagttttagttttggaaagatcattgcaaaccaatgactatagggtaagggcatgattccttgtgactaaaactggagttccaaacctttttttatgtaaggacacaagagtgatgaggaagcagtctggcacctctgaattcactatatgacaatgaaataaaaacaaaaataataataactatatgcataatgaagaacacttacgtagtgcagcctatgatgccaagcactgtactcatattaactcatttaattctcaccagaaccctttgaggcaggtaatactgtcatcacccccatttgacagttaaggaaactgaggcacatccaggccaatatcttgcccaagttcactcggttggtaagtgcgaggccaggatttatattccatgcctgactcttgccatgctgcctcatttgggtccacaagaagcatctgtgtgtacaaagtaaaagatactgtctaatgctttttaaagttgccattttcccctctttctatctttacttgttacctaccttaacttgttacctaccttaaagctaccatagctttcccaatgttctcagaaatagtaatcagagaacattgggaaagctagacaggccagatataactcattcctttctttctacacctactttacaccatgagagataaactatccaacctaccctttgagagctttcctgaaaaattaactgcctaagtgaagccttttctttgtgctcacaggccaacttttgattagcagacagccccatggctaagcactgtcaagcacatgtgtgcaagctggtctttgcggacactgaaagaggcatgacagttctaaacagactgagcttcacgaagcggtgcagaagaattctcatcctgcctcttccatggatgctagtcaatgtgattattcacaaactccttagtgtctctgagcctcagtttctcctgggagaacagtcacacgggatttcccaggtgtcatacagaggagcaagaatggcctaatggacatccctagtacctacgactctgaatgttagtgtgaaagtcaaatgcagatgaaacccccaaattcctactgtcatcattctgaagccttagtatgagaccctcagactgagtcctatgaagacaagccagttataaaccagtttattaatacagtatttacagagagggccactccagtactcccgagatgatactaaagatgctaacttatacgtagaaaggttgcaggaactggtaacatttgtgggaaaacattattaatgtcttcacacatttctagggcagatatgcagggaatttcagttttatttggcacaacctgtattaatgcagggatatcacaagaactcgaatcaacgaaaagataacttttccaacattaggagttgttcaaaaatagaatgtgctgcctcaagcccacggacatacaaggaaagattatatgttaaacaggttagataaccctgtttgaagaatattgcaaaaggaattcttgctttgagagaagaattggctgagatcacttttgaggttcctaatattccccagcctctatgattctataaaaccacttactaaagaaaacaagaatcaaaataaaagcaattcaatttaaatgtcatgtgaaataagatttcatgtgaaactattttgttgtcatagttctatggttaggaataactaagaagactgtgaacacacaaaacatacagactagatgtaataaaggtggttctgtgaagaccttagacaacggagggtaggtctgtgtgatgtccattgcatgcaggcactaaaaagccatccctaccttccatgcaaggtactctagatacaccaaggatcagcaactgcctaactccaggttttttttcagtatgaaatgctgttaagtataaaacactagcgtactctaccttcctatgtcttaaaagcgtaggcaggagcctgggcaaaaggactccagatttcagtagcattttacactacaaaatagggatgtcagcccaactcccgcactgtggcaggaaatccctcccatcacaggatccaggtgacaaagcggacaaagtcagaactcctttggcacaacacgtaagttagaacaagaagcccttttgcgatccactgggaggtggggttccttatatccatgcagatgacacggctccctgaaacacaagtgtgatttacatgtgcatgcgattactgaccattatccaaagctcatgggcacgctttgtcctggacaatgagcatctggtttgccaggatggttcccagctgtttcataatttctgttcagttattgaaataacagagcaaaagcccagctagaaagtgttcaatcttgtgttgatgctaatgacatccaggaataaaaagctgtgctgcctccaactagccagccactgctcacaggacacactgggacacctgtggttaatgattaagtgaattaaggaccacttctcagcagtgctgatgtgttaacactccaggctctgagatgggggaattaatttttcttgctcacagtgctttcctctggcttggggcctgggagtgtggtccagtgggtagaaatgctgcactggtaaaaaacccacacgattttcctgtctccttcttgtgcccactgtacttgcctaggcttcattcagcttcaaggcctcaccctggaaagagatgacccagggcagcaataacaaagcaggtaatgagaagcaagattcttcccttcacatgtaacactctccttgaacttattcaggtgtttactcagtgccaggtactgttctaagtggtttgtatgtattacatcccattttataaatggtcaaactgagacatagagaagtcatgtcttgctcaaaattacaaaggaagtaagtggcagatctgagattcaaacccaggcagtgtcttactgaactgccacgttctcacccttttggtgaaagggtcactcggaaggtactatttccctgatgcaagaagcttgttattcactcagcacaagatctctgttccttatgaactttatttagatattgttaggaaatgaaatttcatgcagccacttggtggcaatgatgggatcataatttacagtgttggaaatgacagcaagaaatactgataagataatccatcagaaggcagtttctccaggggaaggttctctaggtttcactgggaaaaggagacttcccaaggtggcagttgaccctactaaacaagaaatccgcaaaaggacaaagaatgggccgcctccttgtcctgacaaggccaggactgcaggctaactcaccagcagataaacagcccagtaagacataacgaaaatgtgctctggaaaaatgctttcaaaaggggatgaaaaagtcaaggttttacactaaacagggaaggtacattaaggaattaaggaagacagggaatggggaaatgctagctatagacagcaccattaaaatgaaaaacaaaattaacagtactatactttgaaatcatcagttccaaaataacaataaaatattcacccaagaataccaatccaggttttgtgttaggcattgtgccaagtcctctgtatttatggtttcatttacttctcagcaatcatgaaaagtaaatattattttaccaaatgtgcatgtaaggaagctgaggttcagagaggttaagtaatttgccaaagaccacacagctaagattaaaccttggccttggcctgtaaagatagtgtattttacctctacacgaacctaaagctggccatctaagaactattagacatttattgctcttaatgatataactgaattcctcccagtattataacaaatattcttcccgaagcatagaaagaagcttacctatttacatttattttaataaatccaaaaaggttttactgtagcacataaaggagttcaaactttggaaatttgtttccttgactttggtcaaaggcacctacaccaataacaagaacaactcatatttattgagggctcactatgtgttagtgatgtcggcaggctttgtatgaattaactcatttaattttcacaacagccctgtgaggtaaatgctattgttatttcttgctttacagatgaggaaactgtaaaacaggaaagttaaagaacttactcaggtcacacacctaataaggaagaaagctgggatttgacccctggcagtcttaggctctagagtctatgctgttaaccaaaatacaatttcactctctactgaattttaccaaatgctctgctgtcccaggactttccagagcatcaatatgctgtcctgcactgtgattcttagagaaacttgcagcttccccaccacctcaccactcttttgtgggtggaggctgtctaggagcatttggaagaagctactaaggttccaaagaacaaccttccacaccagcggcttctctgggtttgggcttcagcttgcacagctgagctgctttgagactgggcttggttaccctaagagaagagtgaatggtgaccgggcatggtggttcacacctgtaatcccagcactctgggagaccgaggcaggcagatcacttgaggccaggagtttgagaccagcctggctaatatgacaaaaccctatctctactaaaaacacaaagactagctgggcgtggtggagcatgcctgtaatcccagctactcggatggctgaggcataaggattgcttgaatctgggaggcagaggttgcagtgagctgagatgatcgtgcctccaacctgggtgacagagtagactccatctcaaaaaataaattaattaaaaaaaaagaaaaaaggaagaatgcatggtaacagagaatgtgaacaaaaagctgatagcaaatggatgagcatggaattaggaagaattccaacacaagcataaggtgggtctcattagaaatatttaagctgaatttgaccagtcctcaaaagtaaggtctgtccagcttttggcagtcaataaagttcttttatatccatttttctggttaatcctcaggaaaactttggtggtgggaacaagctttgctactgatctccctgcagagctcaggaagtggaggtgtggagagaataagaactgccagggcatgcaggtagtagtagtacatggtgaccctcagaagttgacgtcttttcactccaagtgcagatctactgactccctgggcaggttgcttcccttcccagaaaagacaggaaatgaaagaatttctagggagtactacacaaaaactatgtgttttgttttttgttttttgtttttttttttttgagacggagtcttgctctgttgcccaggctggagtgcagtggcatgatcttggctcactgcaaactccgcctcccgggttcatgccattctcctgcctcagcttcccgagtagctgggactacaggcgcctgccaccacacccggctatttttttgtatttttagtagagacggggtttcaccgtgttatccaggatggtcttgatctcctgatctcgtgatccacctgcctcggcctcccaaaatgctgggattacagtgggcgtgagccactgcgcccggccaaaactatgttttaaatatcctctttgtcatttgaaaccaaaagatgctattgtcttcctgacctctgagcagcattctgcagagctggcccctttaactccatccttatgcttgcatactaaatctttgcttctatagcatcaaactctccaggtgttccttccacttccttatcaaatttctctgctgtctcttccttgtctattctgagttcttagagctcaggcctacactctcttctcatgtgtacttttattaccacaaaccaataattcctatttttcttatttttgacccctcttctatggccatctctaccataatccaactgcatggattgtactactactattactgttggctgctcttcctcatccctgatgtctaatcaacttgcacatcctgcatggtccacaggctacatttgtctcaaatgtgtccacttttctcaatccccactccaccatcatctgtccaaagcatcacactctctggcctagactaacttgtctcctccatttactcttgcttctttccagcaccaactgcagcagcccaagtttcatttgaaaaaggcagatctgattctgttcccttagtgaagacacatcaatggtttcccactcttcttagaataaaattcaaaagtaatcaacatggtctacaaagccctgcatgactgtgccatggcttccctgcctggtatctctccgtgccccactccctcctgtagcgggactctgaccaagccaggtgaggctcccaccctgtggcacgctcttttagcatgccactctcctccaccacggcagtcattgctgtgatgataaatgattacttggctgattatttgcttagtgcctgtttccctcacagatctaatcgtcacaatgggagactgtatttctagtgtctaacatggtgcccacacaacagaggtgttcactgaatatttgtcaaatgatgacctacagaccccaggaaaaggttttaattcaaccttatgcttaaaaacctcatgcttaaaaacaacaacaacaattgagtctaacatccttgaaagcctcagtcacaataaaaagttagaggcttagagagggctgacatttttaggctgccaggttcttactttgtacattaatgctccatgattactggccaataagatacaggtgatatctcttcaaaaaaaaaaaaaaaaattcatgggatggagccaaagtgtatattttttggccagatagaactggttatttttataactggacaatgttaggatggtcttgaagggcactacatgagaatgttggtgtcctgaaagagtcttgaaagaataaaacatactaccagggagcaggtgcttctggggtctatttgattcattcctgtgacttacaggcacgctccccaaaatgaaagtatagaatgtgctcagcaatttgaaacacatatataaatcactaatatcatttcagaactcttgagcagaatcaaacatcaccacaaacttgctcaagattaccagagtagaagccttgacccctgaaggctcccattattcttggatcctaactccatgatacagaataaaacaagatgtattttgtttatgccaagtaatagaaatttttattgagctgagtaaaactagaagaggtcctccttgtactttttctcaccattgatggactcattcactttagctgggtttaatcaagttcctggaactttgttataggttgtacttcaacaatggtcaaaagctgagtcttctctccaccatttaattggcctgaagccacgtccttttcataaagctgatcagtgacaacattcagtgtatattcaaagtccttctaagaatatacagacactgatttagagcttagccaaatccacatggttactcataaatagtaaaggacatgcagggcttccttagaaaccctctggtgggaggtgacatttgagatcacaaaatacaaaagctacaagctacatagtcctgtgtgaccaaaggggtagctaagtgggaatgtttttcctacaaaaggaaaaatgactcgcagtgaaatactcaagctgaactatgggctttaacagtttctatatgacaatgtagtccaagttcctactcaggacaccagaaacacaagtggtcaccaaaggccagggaagcagacatagaaggggacctggcaggagcaggacacagcagaagagttcctggtgggagagaatgtcatgactaaggggttcagaatttacagctctctgagtacttagtattccttgttcttctccactgcgctatagaataagatgaaggatcaaaagagaaagctggaataatctatcaatgctctgtggccagaagcattcctgcttctggtatggagccaaggctcatgcccattggtacatacagcaaaaggcttgtgccctcatgcatgctggctgacgtcttctgtgcaagccaggattgacagggtgtgtctctggctgcacatgcctcagtgagctgaactctgacttgctccatggtagaggttcaagcaaatgccacaagagaagagacacaaaggaggccttggcaatagctctgactgggagcgtgagacagaacccaggtcaaaggcgagcatctgttggccacagattctgtgcccttgcgcagaactccttaaatgttcaggataaaagactatagacatagaggccagatgagggatgtggaaaagcataccaactttgacttatcagtggagacacagaacacatgcagtgacttggtgcttaggctctgcaggccaatcccctggatctgaaacccggttttcttctcaacctttaacaagttattaacctctctaagactcagctgcattatctttagactggagattattgtgaggattaaatgagacaattcgtgtaaagtactaaacacagtaccctgcaacatgggaccaattacttccctccctgaacctcagtttcttctttgttaaatggggattatgagttttgcatgagagataatcaatacaggaaaagagataatgatagtagatgagatagtggctataagcaaagcatcctgcctggtacttgacattactaaaatcactcaataattgtaaccattgggtattattgttgctggtctgatactgatatttgaaggacataatgaggttgatgggatttgctgcaaactggaactgaggcccttactgatttaaaccagggaggctggaccttgatgtaccatttaaaaagcaatctgctgctggtgactgcaattcaccaccctctaaatcttcagtggccacctggcaaagcaagtgaattgctgcaagcccgttaatgagaagcaagctggtgttcgggaaacctgtaaaattactatcccattaccgtgcagttagtgcgcctttcatctgctgcccaacttccccaatagatatgctctctcggtttcctaattgtctagaggctttgatttatctggcagaggaaggaggcctgagatatctgggcaaagttctgggaaggaggctttaacaaatgtctgtaagaccacaaggtgagagtctggcccaggacaaggcatgcagccaactgtggctagcagtatggcttcccacacagataagcagtatctgctgctaaaggcaggtcttgcccacaggctggaggacaggccctgggtactaagggatgtctgggaaaggatctgtgaaacattcttcctagcattcagagcatcaataggcaggtcctactcttccatacttgaaattccacttatctgcttattcactgtgatctagttaatacctatatttcacctctcaactactgacccattcattcatatattactcattccacagatatttatgaggcacctacgacatgctagagatacatcagggaataaaagagataaaatctccttgtcctgatggagcttaaattccagtagggacattcaggcatgtaaaagtatatgtagactatatttgaaggtgctaagggctgtgtaaaagtaataaggcagggcagggaaataggacatgctggagggagggactgtgactttaagtaaagctgagaaggtgctgagaaggtgatatatgggcaagacaggaaggggtgacggccttcacctgcttttctgaaatgaccacaccaccacaaaaagcaagggaagccttttgtttgtaagagcattcaggacttatctgcccttgcagtcaacccctttgtgcctctaagctctgtgtgctcacaggtgggatgtgggcccccagggaatgcttggagagtgaccacaactgagaggcttggggtcagaggtggcccgagcaggtcctcacctcctccagccgccgcctctgctctttctgctcctcgatgcgcttctgacgctcggccagcagctgccgcttgtgctcctcattctcccgctgctgctgctccagctgctgcctccgtagggcctcagaacgctccttgttggccagctgcagcctcagaaagtccctccgcagcgtcgactcccctggcagattcaggatggagctgtgggtaggagagagtgatcaggatcccacgtggggcaggggccatggctaccaagaggccttggaggaggaaagcgggacaaatgattcacccacacacagggaaagaagagcacaggctcctagatcctccgctaattcaatcattcaccccaaagaaacagcatcaggataagagacctgcctccctttcagtacgactgtggccaacaaatgctgcctccatccatagagggatgtcacattctcagagttgtcaccttctccaggactgtccacaccactccctcatccttgggacgtggcaaagatttgtttttaaagactttagccagtgtgcaagccatgagccccagactggattattttcaataaaaatggacaatggtgggcaacaagggtactcagacaagcacagatcggcctcacccacaccaccccctcacaccaaaccccatgaggcagaggccaggctgctcctgtgaagccacgatgaactagcgatggaaaacccttgagtcaaggtcaacacagagccaggatctgagcccaagcctgctgagtccaagtcagggtttgcctgactgtaccacacttaaagggcttggtttggctctggccacagcaggtgcagctaggacttcaacccagctcattggttcctagattctgtttaggtaacagttttgtcttctgtaaaatggtggttgtacatgaatgtgtgtgcatacgacagagatcgagaggacataaataagttctacctacttcgctggtggtcctgggctgccctgctcgcaggtgaacaactaaatgttacagactccttgattctgcacagcagcctaagagggagctaagaaatgacttctgtttattcaaacgtagcccttttaatctttctggaagcttccatttgaaataaatctattaaacacatatttacggagcacctgctatgtggcagtcactgtagtaagctctaaggatacggcagttgctagataaattctccctttaaagttatcttcttatgggacacacatacagacaaataatttcaggtattaataggctctatagaagactaaaattgtaattgtttcagtgacagtggctgggagctgaggtaagctttgaggccttactttagatgggtggtcagaaagacctctctgggaaggaagcagttgatgaagaaggaagaacgttccaggcagagggaaaagcaggtttagaggcctgagaggaaaacaggggtgcaccctatttttgagcaactgaacaccagcccggcttcccagagcagagtgaatgagagggagaagggtatgagaggaggtcagagagataggtgcggggccgcgacagccatgcaggcacgggaaggttttatgcagaagagcaacatgagcagatgggtttggctgctaaatggatgacctagcgaggggtacaggggcaagcacagcaagccggactgctgctgcagagtggttctggggtggggacaccacccagggcgagagcagagcgggtggaggagggaaggagcgtttggggatagaggtcacgaagcctgtggacagatctgacatgtggagtgagggatgacttgcaggttctgtcttggtggctgggtgacggtggtaacgagaacaggaatgaggaatgctgagggaggagcaagtttcgtggcagttaacaagaggaccaaggatcggttttggagagtagttagtgtgctgtgtgagatactgccatgaaaagacataaaaaggctttgttcgtgatgttccatagacaatgcttggcgtctactcacaagccttctctaaaacttagagcctttgtgtcaaactctaaaaccccaaacgatggtgcttatctacacaggccacttgccctgtgcagaggggagggacttgggaacccagcctcccatgcacacgaggatgctccattaatattaattgatattgaatcaatgtcagaagatctgagctgtgttagtgactcaaccattaactctgtgtgtgacctgggtgcaacccttaggctgtcgcctcatttctaaaatgagataaccattgtccttttctatttttcaggatttcatgaagattaattagatacgtccataaaaacaggacttggacttaaagtataataacaacaacaacaggacttggaacataatcttcagcatgatataatgacatgttataattacggaagtgttaaggtacggctgggctggctcgttgagtgactcctaatatgcagtttagcaagtgttagaaagacagggtttctcagttctacagaaagtggtcagaaggctgacacagtaaccttttgggtaagcttttgaacactggtgtacaacttctctgaaagcagggcgtttggtcctctgcctttcaggaatgttcattttctatgtcactacttggcagtcatcttctttatgcagctaaaccggggacggccaacatgctatgtatcagatggtaggaaagaagtattcggtctttgaccttgaggaatcctgtggcaggtgaagagagaaaaactggatggctctgaaagctcagttccatcttcttatagaagcttagcaagaatccagctcagtaggtctgagttagcataaaaaaagaacacatggtatctggctcattctagcagtggtggctaagctggccccttttctggtcagaaagctctccctcagtggtacaggaactgatccttctggagcattagggtccactccttggatggcttgaggagggaggccacacctcaatgagtcttctgcttgtgcaattccccccaagtcttacttcacatgtatactgcatggcaccatgggatgtgggcctgccctccttgactcaacaagctgaattcgctcaccaaagagatatcctggcagtgcaagcacactaaccttaattacttataaacacagactagaagaaagtcagaatcaaagtcaagtggaattcaaaatgtaggcatgacaataaaacagccctggattctgaggtccaacaggtgacaacaggaatggcccaaaagtatttgtttggagttcatctctacatataatttgattttctgaaaatcactttctcctggattaggctgcaatgaaaataccaaggcatgtgacaaggacagtggctacccgaatgggcttctcaaaggtgtgaagtaacgaactgaataacgcaagtccgaaaataccacttaggtctctagaaagttgcagttttaagtatttttagtcctgcattgcccagataattagccttctacccattctacgtgttacatatgtaagaaaacaagctcttacgatagagaccataaatcttgggggacaagataaagaatatgctgatttccacattttcgtaatggtctgcctagggaaattttcccaaattaatgagtatgttcatgggcaataaattaaataagaccaccctggtggattcttaaaaacgaacctataaatcaaaaggaaagtgaatttcacacaagcacaattcagaatgtgaacattagaagacttggcttttgctctcatacctgggctctcctgagtcattctcctcctcttcttcctcacttccactgtactcatactctgtctcatctgaagaaagatcccagcatgttagtgcacaaaaagatgctatggctcagtaaagcccaaccccgtctcttatatataaataaatagacacccaaagagttgtagttaacacagcgctggaacggtctccaggcttgtgatttaatggttcccataagtatatgaaattaaccacattcaaggctgtctcggctgactctagatatctgtccccagtgcctagtgttcacatgagaaggaattaaaaaataattttttaatttttttattaatttaatttcaattaaaaataacttgtttggccgggcacggtggctcacgcctgtaatcccagcactttgggaggctgaggcgggcggatcacaaggtcaggagatcgagaccatcctggctaacatggcaaaaccccgtctctactaaaaatacaaaaaaaattagccgggcgtggtggcgggtgcctgtagtcccagctacttgggaggctgaggcaggagaatggcgcaaacccaggagggggagcttgtagtgagccaagatcgtgccactgcactctagcatgggcgacagagcgaggccctgtctcaaaataataatataataataataataatttgtttgtgttattcccactataaagccacccatatcaaacccattggccctttgtaacttattgatggtattaaccatttttaaagtaggattttattatgacttacatggacttgcaaactgtctttagactattttgctaagtgcaacaaagaaacttttgacaataggtgctattaaaaatatatagtggccgggtgcggtggttcacgcctgtaatcccagcactttgggaggccaaggtgggcggatcatgaggtcagaagatcgagaccatctaggctaacacagtgaaaccccatctctactaaaaatacaaaaaaaaattagctgggcgtggttacaggcaccggtagtcccagctacttgggaggctgaggcaggagaatggcatgaacctggaaggtggagcttgcagtgagccaagatcgcaccactgcactcaagcctgggtgatagagtgagactccgtctcaaatatatatttaaaatttaaaaaatgtatatctatatttaaaatgtgttttgattgatccactagggacagtcctttaattcagcaaaatgggaagcagtttacatgtgtgaatgaataagattgaggcttgctttggaagagatcaaatctaatatgtgagatgagtaaatatcagagccttcatgattgtgaagaaagggaaggaatatttagtgggtatctcccacaccagtcactactgctagatattttactctgttctctcatttatttttcataataaccctccaaattagtgtctatttttcaagcaagaatactgaaattacaagaggttaagtaatataaccaatgttatctcattaataaaaggtcaatctaggatttggatttagaattcaatccagaacttttccaacttaaaaaatagtgctctttccaacatattatatgctaaatagcagtacatataaagagcaatgagatatcaaagaaaggaacagctagtgccactggtcataatggaggaagagacttgaagtctttggagaaaaaatgaactgggctttggaaggtcagtggcccttctccaggcagttagcagctggcacttgtgggaaaaggacactctaagcaacatatccacatgagtaaggctggcagtattacagtgcataatatgttcaggaaacaatgagctgtgagtagttaggtgcctgggtgtgagaaaaccttatggagggacaaaggctggcagggatgaaatggctcactgattcttataaatgccatgctgagaactttcctattggcaatgaggaacccttggaggagcttttaagcaaaggaaggtgtcacattactcctatctcttcatagctgtaggttaataattacaaccttgaagacatttgcacatccctaaaaagaaactgaaactgcaatttagttatgttaccaccaggaggcagcagtcacacagtgagaatgctcagatttgataaacatgccttgcttttcacactagccattaaagagataatgaaggaaagccaaaagtttgatgagttcaagtgtatttttaaaatcacaacttagcttcatacatttaggtatgtatgaagctttcaggctacttatttttaaaatattagttcaccaaaatataaagaacctgcataaagcattttaatactccaccctaaaaatgaaatattccaaactttttcaaaatgaataaacagatttcaaagtaaaaatgcagaaattttatctaataaaggaaattacagcaaggaaaagaagcacacaattattccaattacttctactctctagggtaaatccttcatttgtcaggcttctcaatttaatatttaatacttcaccaaaatttgcttttgactgcttttatattactgggttaaatttggcatgtgtcagcatatgttagggaaaaaatatcaggttgaaaaaaatcacaaataatgcaaaatagaattgctttgattgattctaccaaaagttggtcatagaacaactaagaaagtgaaaagtaatattagagcaaactaagtcatttgattaaactgaacaaatggaattagatctcatttgatcaaacaccattccttggggagcagacaaaaaggagactagaactgtgattctggtggccctaagcctaaacaggcttagattccttaaattactacataactcttgaacatacctattcccaagaatcttacttttccactctgcagagaacaaacacattaaaaatgatctatcttcatggcatggtgagttctgagtcacattccagagtttgtgccccacaaaatgtggaaacaacctgaggcacaggcttcaatcactcttatttatgccccagagggagatgggtcatgagttctcacaaagtactctgagtaagtgatgaaaaagtatgggtcaataagtaattgcctacataagaataactgatatttactgagtgcatctatgtcctggacattatgtcaagcattttaaatgcattacctcgtttaatctttgcaactatttgaggcagtagatattagtagtatactctcaatcttattttaaagatgagaaaactggagtgatgttcacataactgataaggggcagagttagaatttgaacccagaatatgaatctgaaaacagtctgagcacttaaactatgctatatattcaccgtataataaaatgtccttttgagagaagttagcatttaatggttgcatgtctgacacactgccctaaaatatgcccttaaaaattctgacttcatggagtagcccaagaccaccatggacaaggagcaattgaaaaatcagtcctggaacttttgagtttgacctatgtatttctcttcatgcctagttcctccagcttgggctggcctcccagctccttagggtctaattgacatcttattaactgcagatgagccaccgttttggcctagcttcacaacaatgtatgatagtctaagctgatcatacattccttcaagtccctgctagctgcataagaattcttccctggggctgggtttggtggcccatgcctataataccagcactttgggaggctgaggcaggaggatttcttgagttcagcagttcaagaccagcctgggcaacatagtgagacctcgtctctactaaaaatctaaaaaaatataaaatcagccaggcatggtggtgtgcacctgtagtcccagctacttgggaggctaagatgggaggatcacttgagcccgggagatagaggttgcagtgagcactccagcctgagcaacagagacagagcctgtctcaaaaaataaaaaataaaaaaagtgctgggtgggtggctcatgcctataatcccagcactttgagaggctgaggtggaggatcccttgagcccaggagtttgagaccagcctgagcaacaaagttagaactcatctcaaaaaaaaaaaaaaaaaaaaaggaactctttctggaaccttcactgagattctctcatcctgccttagccctctgctgatcttacctctccaatccagtctcaactttcatactgctcaccgcccccaccgctagtccccagcttgtgttatgggtattaactgcagaggcaaagaagaaaggaaatgcaaataacagaaaggcagcctctgtcctgtctgtgggctaccctccgctactgcctctgaactgaagagaggagagaaatggagaggaaggaagcaagaacaagcacatcaccatgtgcctcccctcccatcctcagtctctggtcttcctctctactgtccactcaccacactgttaatgctcagctttccagcctcacactgcctttcactgctatcctcccagcagcaaccccctcctgctgtctacccagaaagccctcactgctgtcctctccatttctctcttcccatactctaacttgccctacctcagctagccattaaacctgctccagaccatgcaagtttttaccttggtcatggcgcagtcaatatgctagtcaatctccaagaacaaatttgtcttcctttagaaaggtactgtttcctcaaagataaatcctatgccagagaggcacagggtaggggagtgctggtgagagataccataccgatgattatggcagcaagcacacaatgtagtagaaattagtggtgaaccttagctatgactcatgagttgttaattggaatgcaaagttcaaaagtgattctgaaattactggtttcaaaatttgcctaatgaaaattctcttcaccatataagaatcttgctcatttctacaaaatgcactccccttacccatccaaccttagtttcacttttctttggcttgcattttgtctcatttggcagctcacctcaatgttccctaatatacagtattagcataccatttctatgctagttaaaaatgtaagcttccattcaaaaaggtagggtgcagcctgagactccaagtttggactcatgttctttcaatgatgcagtgaagagacagtgacatataagagctagagtcacaaagatgtgcttttgcatatataaaataaagaagtgtgttaaatgaccttcagctcaaaaatctgatgttccattcagcaagcctggcaacctaatgatcttttctatcactgcaactataaaaaaattatttctgacttctaaataacagaattagaaatgagcctcagagcacataaatttaaatgttgaagaatgtcagtacagaaaaatgtcaactagatgaatttttttctttaggttatctgtcttctgtagagttttagtcttctaaacatgaatattaatttgaattaagaaaatcacttgtcatattaaagtacttcatagtatcattcaacatgactttgttcagtgcctggcagaggtaatgtttcttgcagttctatttttttcatgaaagattctacttcaatagtctcacgccactgatgcccagaggctgtggtctcagagacagcccctcgcactaaagaataatgcaggcccatttgaaatccccatagtcacctccaaatacatcaagcgcccatgattcactccatcttttgtttctgctgctgaaatacaaatgtgcgtctaacctttttctcctcgcttcttctttgttctatcaatatggtccttgagttgaatgcggacctgtcgctcattaggttggtctcgtataaatggatgcttcatcaattgttctgttgctggtcgctggctgtgattctttaccaagcagctctcaataaatgactggaatttttttgacctgccaaacaaaagaaatgaatccacagataaaacggcgatccaaagaaaagcaaatgtgtaatttctgaaatgctgggactttttctttttttaaggtccaattggctggcatagggatcatccactaatcagaaaacagttgtagcactatattaggcataatgggttcaaaggcatcatcatcatcaacgtgcaattgaggtagcagaaggtagttatgcacatgaaagcatttttgcacaatttatatgtaacattacatagcagaccaaaaggacgcagggaagaaaaagacccctatgggaatcacatctagaagggctattggaataaggaaaccatagctgggcctttaaaaattaggagaaaatcactctggggaaaggatagttcagatatgtaggatgacagtgaaaaactcaggctaggatgagaataatgtatgttgggggacactgaggtgagccacttaaataaggcagaagatgcaagctggaggaaagtaaaaccaaggttggataggtaacagggagtgcatttcgtagaaatgagcaagatttttatatgatgaagtgaactttgattaggcaaactttgtaaccagtagtttcagaatcacttttgaacgctgctttccaaggaataagaacatataagtatatgtgtacctttgtcgttaactcaaggacttagacatttaactttaaagaattaagttcacacccagatgcaaatttatcttcctctagaaaggcaatatttcctcaaagataaaccccacgccagagacctggcaggggagagctggcgagagataccatacctacgattatggcagtaaggccacaatgtggcagaaattaatggtggacttcagccgtgattcatgagttaagcacgcatgttcttgctgaaagttccaagaaattgttcagagtcatcaataattaagcttatgactctatagcatgcttttccaaggcactccaggagaccttgatgaaactcgggtcacccttcctgtcctgcccagagcaggaatgatctgttttgtgctctctgttgctctcctgtggtgcacaggggagatacaggagtggatcccaggactgagcctttgcccggcagtccctgcatacatactctccaggcctgagaggtgccctcaccacacagaacacaatggagagcatgttcttcaacactcaaacatgacagggcacttttgtatgcaccactctctagtgctgccctggtcaaagcagtttttcactttattccatgtttttaaagtactgaatcactggtattttttttttccgctctaaatttctaagctacattcaagcttttaaaatattttacctagaaataaaggtagcctactgtgcttggggttgccccaggatgaatcagcgttggccacactgtggactagaaatagtgacagcaggacactctgtgcacctccttgttaagtgcttccatgcatatccttgcttcttcccactgaaaatcatcagcagcatcaacgtgcctgagccatctttgcatcatgagcacactacctgagctgtgtgtttggtgcatgagtgaatgcgtgatgaaggttctggacaagagctgcaatatggccaccttcaagtctgcacttttgagggacagaaagggaggtttggagagcggatattcttctctttctcagatcaatcaaataaatctgtggaggcataaatatgatctcatctaagaagaaaccttgccagaaaaatgtaatgaaataaaggacactcctaaggaatgaattgaagagaatgaggctgacctgcatgaagatataaacaaactccatacagtacttttccaggtagaaaaatcagtattaaaaagatgaaaacaaaaattaagacagaaaggtatgaaatatttataaggaatataaatggcagttctctttttcttgctggcaactagaaggaagtgcttattttattatcattatttttttttttttagatggagtcttgctctgtcacccaggctggagtgcaatggcatgatctcagctcactgcaacctctgcctctcacgttcaagtgattctcctgcctcagcctcctgagtagctgggactacaggtgtatgacaccacacctggataatttttgtatttttagtagagacagggttttgccatgttgaccaggctggtctcaaactcctgacctcagatgattcgcctacctcagcctcccaaagtgctggtattacaggcatgggccaccgcacctgccagaagtgcttttttttataaagtactcaaccaactattaattagaggttgataaataaaagaaatcacattcaatttaaaagtaagatccagatttaatagactgtacagtctattccctgatattggcatctaaaataacagtcagagaaatctccagatctccagaatggaatagtgttcaagtttaatgaaattagttattaaacagagtactttttcccagtatgccttgctgggagaaaaaactcagagatattcaagagaataactttgggcctaaaagatgggcccacttgtgcagaactacaaagctggtaatatatttcatatcttcttcaagtggcaccctttgaagagaaaataatgtttacttaaaatgagtcttcaaagaaggattcgtagtgtcttaagttagcatgaccaaagaatcaatatgcttaattacacacttatttaagagtgaaaacacttcacctatgttgaatattacctcactgtttgctgagtgttctaatgagtttaaagtacatttatataactttattgcttgaatctctgctgatagtaatgtagttctgtctcttataaaataaaaacacctaaggttagtaaaactgatttcccaagggttggcatggagaaataaatggtaatgattggtacctacagtctgataatactagttctactatcagagtcactaaatactttatcttcccagattgaacctgtttatatgttaaattgtgttgggggaattcaaaatgctggaaagattgttacattagctattataatcagttgggttaaaagtttttggtaatcatcagactccctaaacgcaatttggcctaaaatttgcattggccctgccctatttccaaaagctaccctcttcctttactttgagttgcatcacttactaacttggacaaattacttaacttctatgtgtctcagtttccctggctgcattcaatggggatattattagtacttatctcaaaaaaagttatgataagtgaattaattcatgtaaaatattgagaacagtgcctggtatcataaatgccacatatgtgtttgctattatgatgatgatgactatgatgacattgcccccagcaatctctgagcatcattggacttaaggaacacagcatccgcctttaggacttaggagcagaaatccccacttctggccaggtgcggtagttcacacctataatcccagtgctttgggaggctgagatggatggattgcttgaggccaggagttcgagaccagcctgggcaatatagcaagacggtctctttataaacaatagaaaaaagtagctgagcatggtggcatgcacctgtagttctagccactggggaggctgaggtgggaggatcatttgagcccaggagtttgaggctgcagtgagctatgattgcaccactgtacactagcctgggtgacagaatgagactctgtctctaaaaaaaaagaaatcctcatttctgttgaactaagtaaacatagagttctttaagggaattatttcacgtatgggttaaatagcttagcaggaggagtcaactgggctgttatctccaagaagcctgcacaaacaggttaatttttaaagtctgtgtaatagtttttagctggattttaataaagtccaaagttcaaagtcacattactactagaatattcagtctagtagaaggaatttctgatacacacacacgaactttgtcctatctcaaaagtctgacaacccaccaagaatcagaactggtgcctcataaaataacgggggtgatttttagccttggagcaaaagcaggaggctgggtccaggctggttctcccagtaaggaggctagaactcgtgcaaatacaccacttagcctcactgggcctgcacacctgcatctgaagcatgagtggcttggaccagtggagcttgtacatataagcagttatgatttttctaatgacctcaactgagtgctgctttgcctgtgtgggctcttcaaatttaaagggcacatgaaagattcactgtcttatacttaatggagccattcctatccttctccagaaagtcctggagggaagcagtgacactgagtatacttgcgagggcaggtgagtgtggatgagcagggtggcaagagaaggtaggagaaaatcttttgaaggagatggtttacccctgcgagtggaatctacgcacgcacaagagacaggaagagagaatgggtatcccagtcttgcttttcacttgctggtgctgatatggaggtagagggtgagagtatctttggtttcctctgattccacaaaggttacaaccctcccagacaacttattattaaatggctgagctgcctgaacattcagtggtgccctaacttcatcatcccataccacaaaggcctctcctcatcataccaatagggaaggaagaactgggctcctgtgagtggtggtggtctcctttccctccacgatgacagtggaaagagcagtgccactgcctttatttctcaaatcttgaaggtacaagttaaaaaacaaaaaaaaagttcacactaagagaccagtttatgccttgtatgttgtagactcagtcatgttgaaaatgatgctttattgaatgtttgccatgagaagagttcatggccctgtctcaacaatggcgccccctttggtcaggtgttgatatatacactgagaacaaggcatttaacccggtaactcatttaggtagagaatagctggaaataaaagaatgttttggaattttgtctcttggtcgggggagggagtcttttcctcttaaataattaaaataaaaaacataaacaaaatgtttcatttcctctcaaacactagagtctattaaagtaaaccctaacttacttcaaatcactttggacctgcgctttcaagataaaatactctgaagtgtttaaatattttcacttaaaaactggtggaattgtattgcagagaaatgggagccatgtctgctgtcaagtatcatgtgcctggaggctgcaccaccacctctacaaaggctgggatcgaagtgtgaaatggcacattatcagggcttttgtttccccggtctctctctagcaatcaggttacttttcctttccctgtctgacaatatgggacttgttcccatagctttcctactcagttttccttacacatcagggaaaggtgtgcaaggtggcaggatgagatgaaattggcctggacttctcagtgtttccaaacttctcctgctccctccagcattattaaaattagttgttgtcaaaggtttgaagccgaaaaatcagactgcattgtcctaaaagtttgtatttctcaaacaaggtcagcacaccgttgatcttttttgggtctcagtcggtgaaaactgacactgtagggcaagggctgttcactcacttttctgtggggtcaggtaggtcacaaaaaggggtggtgtagaccatggttaagatgaaaacaggagatgtggccaggcgcggtggctcacgcctgtaatcccagcactttgggaggccgaggcgggcggatcatgaggtcaggagatcaagaccatcctggccaacacggtgaaaccctgtctctactaaaaaaaaaaaaaaaaatacaaaaaattagcagggcatggtggcgggcgcctgtagtcctagctactcaggagactgaggcaggagaatggcgtgaacccgggaggcagagcttgcagtgagccgagatcgtgccactgcactccagcctgggcgacagagcgagactccgtctcaaaaaaaaaaaaaaagaaaagaaaagaaaagaaaacaggagatgtatactaaccaactgacaccagcttctgagttggggggaggtggcagctggaggagaaggacaatcacttgtcctaaatgggagcagcagctagcatctttgcaggcagttcactgcatctttgcaagaaaaaggccagaaatctaaatgtaatgctcaattgacagatttttaagtgttgccaattaatacacatatttttaaaacagggtatatgaccatagtgtgacagccaaatacatttgtggagggccagtttgtcctcctctgtggaaaagctcagaatacgtgtcctgcagcagtaaagggagacaaggagaagatagggcagggaacagggtaagtaaagcccactgtatacaccagactcagctcagatatcaagcaggaacctagcagagggctttgtagtgtcactgtcacttccagggaagagaactgcgccagtccctctccccgggagtctgatccagggagaagagaggaagcagggtgttggggtgctttgccgatcacatgatgtatgacacccaatgggagggctgttgctggggagagaagggttgtcttgcaccacaatgaccctctgcagaggaaggaggagcagggaacgctctgcctccttgttaccaatagcaactctcactcccctcgcagggcccggcaattctgaggctgccatctcttttctggctgtttccttccctctttctgtgcagtgtgccctttcctctgttccaccagggtggctctcattagtagatgactggtggtaattaaggctgccccctgtatggtagaggtgagcctgtgtgtgggtgggtgggaaacatgaggaccccagtcaagcgcctgatcatgaagggctatggaaaggggcagaaggatcctgtccctcatggtctcactgcccaggacttatctctagaaaaaggataggaggtcacaaatagtgcaggaattgacctcagaccatgagtaatccgagattcaagaatgtatcagggaggatacaccatttccataggaagaaaggaggaagcaatgaattttggttatggaataataagataggaagatcccaactatataattatccccaaaaagtcaaacatccaacatctggcttaacctgtagaactgtttcccaaatgtcagtcagtcatatcctatcaacataatttttgccgtaccctcacaccactcatactagtattcatgtagtagtttcctttaaattaagccactgttttatgtaagtttatcaaaaggaaaagttaaatcgctgccccaaataagaagccagtatcacctgccatatgtgaaaacagtagtaaaaacaaaaaaactgcaaatgctcatacacgagccagagaaataatctcaaacattacctggtatgtatatgcacttagggaatgattgttgtaaggaatagaagagaaatcagccaatctaacaggctgactctctaaactatcaccctctctgataagctgttctgtgctgccaggaaagatatgacttggagttatagatcaaagagctttcatgttattacttggcttcacttacccattttggctaataatttcttaccttaaaggtgggggaataaagacctgctgtacaaacagtagatactcaatatatactttaagatgaatgacagcatatggaaagtaattcaccaagtcatcatacatgttagtctcattctatcagcaggacctagggattagagctaatccaaaatagaatcacaagaaaacctcacccttagatctgcgaaacatcgaagaccaaactcaccacttcttagacttcagccgaggcgctgggttccgggggatgaggaagagagctctcatggggtgcatgtcacagagagctgcaagagaccaaaacaagggccagctacagttaggaggccaaacccaggccaagcccgtcttggctgtgcagataatggctgcccaatgacccactcagtttacacaccaccagtgagcacaaagtcagaatatccaaatgcttctgagcatttgaaagatccaatatccacttacaggagtctcataaaatacaacatggttcacatagctactgctaacatttctagtgaatacatgtttacttcatatttaaggaaactaagttaaagggtcaacaaccagccatccttgctgtgaatgaccacctgacatttaaagtaaataccatcagatgacaactacaatggagatggtaagctatttttaattagtaaaagcctaagccataaataaaaggcatttcattatcccgtctatttcttacacgtcgacagctcatccaaatgcaattgttatctacacagatttttggagtccaaaacaccagccccagagccccattttctctgtttccagatatcccgaatggcttttcaggtttcgtaacgggttttgtttcattttgtttttaaattcactggccccaggaagcccagaggattaagtcacacagagtctggcagaaaaacaaagttataaaaagatctcatcttgtaaacatgacattatcgtttatagtgaaagcactcatatgttcttattttaataaaatattttattagtttacttttcaaacatctgggagaatttctactttgtagctagaataagaatatatgctccctaaaagccaaaggattctgtgggcagaagtttatttttagccctgtctaccactcatcaagaatgataatatggtttaagactgcaatatattatttttctgattcacacatgcctattagcattgtgaatgagggcaattttgtcaaccagcactccaaatcaatcatgctacagatgagttctaccaattctagactgggaagtaagaaaacgatgacaacccgaaggtaaaagtcataagtataatgacctgtcgtgcaaataaagggcctatttttgtcctagtcctttgagatgcagacaccaaggatattactgggtaaattactatgtgaatggaaacagggaaggagccaggcagtatgggaagtcatcagattgctatgcaagtctgaccctgagtgaaggagagagggagaaaaggtaggtggaagggtcccagcctgtcctgcaggtcttgtaaagtcataggggattacttgggtgaaagttgcctacaaaggaatcttgtgtcctccaggaaagggcctgccttagtatccccactgtgctaggtcactggcggggagtggcccttgaaaggtgcggcctgctgccattgcagcagctggggctgacaatcagttacacttcctatatggaagtctgtgaggcacagtctcatgacagagactctctgctggggccaatactccaaatctcaaggaactgagattctcaagactgctggagccctagccactctgtctcaaatagcagggaaatctaaaattttaaacatcagtattttaagaggagtgatagccattgagtggagtctttgtataacctgtgcactgaaaattaattttggattttcatacattggagtttatagtcttgtgagttggtcacagttttatgtcaggtgaggagtagtccaagaataaatgatgtacagaatctgtaaaacaaacaagactccccaaagtatgctttctttttcttccttttttttttttctaataaaaacaggattctcccactgctctgaaatgaatggattcctggttgatttaagatgactctgctttctaaatatgccagcttgaatccatgcagggctcggtgtagtggaagtaaagcaactgcagctcctggcaaggaaacttcagtacctgcagagcagaccagcaacagatttcaccccagaggagggtacttacggggagcaccttctgccatttcaatggcggtgatacccaaagaccacaagtcactctgaaaaagaaggggcagacacacacataaattcagtcaacaaaggacaacttggttaaacctggtaattgcttcagaacttcctgtgaaagtcattcagttttctgtttacaaacctatttcttccactaaccttcaaagcagaaacagtcttacttttcattgacagtaccactcatggtgtctggcacatggcagcttatcaataaatgtatgaaaaatgaatataaacaattttaaattaattcgttactgaaacttatctgtgggttgaaccataggaaattgctgctatttgactgtttataacaccatcattgagctataattgtcatataataaactgtacctaaagtacaccatttgataaggtatgacgtagggatcctcctgtgaacacatcatcacagtcaaaacagtaaacatacccatcatcccccaaagatctcatttgcctccttcctttcctgcctgaacccatccccactctcctgtccctaggcaaccaatgatctgctttctgtcactatgaattagtttgtaacttccaaagttttgtataagtgaaatcacatcatatgtggtcttatgtattcgatctgtttcacgtagaatagtgtttctgaagtccacccatgttgtagtacatatcagtatctcactcctttttattgttgtgtagtattccattctatggacatatcactgtttttgcatttggactgtttctagtttgggctattacagatacaggtgctgcaaacattggtgtacaaatccgagggtgtatgcttttatttcttttagttaaatacctgagagtggaatggctggatcagatagtaggtgttatttatattcaattggtttaactagaaaaacagcaatttcatatggttttacctaataagatgaggacagggagactttttgatgatggcattcactgatgtctctcttgtgcttagatcagagttgggcacagtaggaggtactcaaagtatttgttgaaaagataaacaattattgcctattttgtgagtagactagtatgtaacaatagaggccagtatacctttatattatttcttatgctcagagtgacttttattctctgaacagaattttctaggctaatgcctccatttctacctgtacaatctccatctctaacaatattctcctcccatactctgtctgtggctcagtagtctctaaatattgcatgagagggggaatatcaagagatggggaaaacctggttagaaaacaccaagaagaggcttgctgcctcagtttcacagcagattggtaagaaaatctagtatcaaatttggttcaatggcccacatcctaatatagatatttcattttaaatacctcatgcattttgtacatttttcaaaattgtctcagattagagtgatcaaaggtaagtttccttgctattgccatcaaacaaatgtcaaggccacatgaaaaagagatgtaactggaagagagcttcataaaattcataaccttcatgctgagtcactccccagaactaagtttctcaatatcctgtgaaatgacactcagggctcttcagtaattgggcagaggtctgcacaatgtggagggggttttctagggggtctagcctcttgcctaaagtgcagtctacctgagagcaggtggctggggcacatgtgtaacctcacactaggagcaagggggattctttcaatgttaccagttctcagttcaactgggaatagcaatgcaccttcacaacaccatcattctaagactccaaggaactctctgcatacaacacaactcacaaagtcaactcttgtcccttctctttgttatgtttcaagatgtacacaaagattttcattaaacgcaatctgcaccccgtgtttctctggcctagcaagtgactgagtctcccagaggctcttggcctcgcttagtgaggttatttccggagctgatggggatggctcaacccatctattacaagttggctcaggagcaataactggtaaagacaaaaacgcagttctattgtacctgggttttttgttttttttttttctttgagacggagtctcgctctgtcgcccaggctggagtgcagtggtgcaatcttggctcactgcaagctccgcctcctgggttcacgccattctcctgcctcagcctcccgagtagctgggactacaggtgcctgccaccatgcccggctaattttttgtgtttttagtagagacgggtttcacagtgttagtcaggatggtcttgatctcctgacctcgtgatccacctgcctcagcctcccaaagtgctgggattacaggcatgagccaccgtgcccggcctgtacctggggttttatggttgatagacaaagataatcatttcggaacatgagagaaacactgaatcatttgctgttcaggaggctttaaacaggaaacacagcaataatagtctggaaatggtgggttggctcttaaggtccctgtgctattttgataagactctagtatctccagaccttggtagttctaccaccattttacccaaatccctaggaactgagagtttctatagcgtgaaataagacacaagtaagaaggtggcagccaggctctatggccctaactgcaacagaagggtccaatttaaatggctttcaagtccagaaagctttgagctgggttgaaaaccaatacatgtgaaagaaaatgatggttctggggtaagaagaactcaaggccaggcctcaggtcaggaagaaggaaaatgctcgaaggcccagcctttggatcttgactcaagctgttacctcttcctgcagcacctcagcagtgatgtgctagctgactccctcacctccccaaagcctgctcaacccctgtgttctcaacgaggacccctgggacctccccccagcactgctcatgccccttccccatatttgtcccccacagaactaaccacctctaacatacgacatgtttattcatcactaatttaccatgttttgtgttgattgcttgtgccctttacctctaacacacatacataagaacctaagagccacagggcaaggatctttgttctgttgtctgatgtatccaaagtacctagaactgctcctggcacacagtaggcccttaataaatatttattgaatgaatgaacaaatgaaagatacatgagagaacgtagcaaaacctaagtgttctagggctagtagactctttgcagatcacctagccaaacctttcacttcacaaatgagggaacatgacttacccaagatcaaagagcaacttagcagctggttttaaactgagctgggtcttctgcttcctaggccagttctcttttaactagcatcacaatctaaggacttgagtattcaccatttttccccttatcatttttgttatcaaaatgcatttttaatccataaaataattacttcagattcctactttgtccataggtgactgaaggtgctggcaactcaataaaggtactgagattcagtgaggtactccagtttcatgctataaaactcgcctcaatttcccaatggcaacatggattggtagaaagaaagaaacaggtattgattgattgattgagatgaggtttcactatgtggctcaggctggtcttgaactcctgggctcaagcaatcctcccacctcgggttctcaaagtgttgggattatgggcatgagccactacacccagctgagaataggcttttaagacaggcagatccgaattcaaatagaggtttccaatttagctacatgcagactgttgctcagagcttagctttctcaattgcacaatggaaataaccgtggcatgcatgtattgatcaggtatgctgctagcacaaaatctggcacagagtagggctcaagaatattgatttccttcttctccactgtcaggtgacactgcctttgcctgcccaacttagtcttctatgatttcccttcatttagttgtggcagaaattgtttattggctaacccaatggtcattttcaaccctcatttttgttgctgcttccatttcagagtatagcaaagccacacttgcctatcctgactccccgacagctaaggatggcagttagggatgtgacatagttttctccaatgagacataagcaaacatcttctgggagcttctgcttttcctgaaataagggacaaatatagctagtgtcttgctaactttttcccacttcttagtgccttgaataaaaatatgatatctggagctacagcatccatcttgcaaccatgagttattgccaacagactaatgatgccagcacagaaagctaggagcttcggtttctgaaggtatcagtgaagcatcacatgaaccctgaactgcctacctctagatttctggtgacataagaaacgtaagtacagacaaaagcattcctaagtgataatacacatacagcagtaatttgaagaacatactttgacagtaaggaaatggagaggtctcatttgttaggtaatcctggatttattccacaggaagcaagaaggtttagggaaaaaatatgtactttatttagtacacatcacctcagaatccctcttgggcagcctttccctaagccaccagaacacccctttcaaaccaaaggtcatatcaccacaaatacctgtgcatactctgctaagtcacatgacctagtcaattctgctgcttccttaagccttcatttgatatcattgttaggattttttttttttttttttttttttttttggctggggttctcttgttttccaaaaggaacatttatattcctggtcatatatatccaaagttgcttgtaagctacactcaactgcccatgctagaaagccataaatgtccttgacaggccttgtttagccgttggatacattagcgagtcccaaagacacttcagaacttaagtaaaggagaaaatgctccaattaccactggcaagacagatcacaggagacaagcaagggaagatggaagaacaagatgaggaaagagtcagaaagagataagtttcgttcatggccatggtgtgactcattttggcagaagctggataattcattattccagaggtgttgtgcagcctagcctgtggcatgattaataccctagcgctatgtgcattacaaacagaagagagacaaattctagtgcctttgggaaggcagaggcaagacagaacttttggctgctggaaagggtgggagtggggaacagctgatacacaagcaacttgaacagaacaagaaagcattccttctggggctgggctgctcaacacagtgaagaaaagcaacacgtttagatgtctgaaccagccacagaagaatgagaggctgtgtggcacaagacaagaaccccaatgtgcaccatgaggtagaaggtgcctatggtctgcagccagacccaactgtgacacaactaacaactctgagcccatgaaaagaactgcaacaggaaaagaacacatgtcttgcaggactggtaagagaattcaataaggaagaatatgcaaaaagtgcctaatatacaatgcagtacatgctgcattgggtattcaacgaatgtgggtacagatagacccttaggaccagatatcatcaactggcagttcaaccagcaaaccagagtcaggtaagatgacagggagctctggtactcagtggtggtcaaagaggtcacagggaccatgcaggcataaacaagaagcttacaggaagcaaacaggaaaacgtgtgtcctccttcctcctccagacttgatctcccgttctctattgctccctgctggcagagcctgataagaagtcagatggacaaacagaagggaggacagctgactcctagctccattatcacaaagcagagagcagcacggcagtccacagttgacagacaatagcttaataatgggcacagccagcatactgtatcacagagcagaaaatcgtcttttgttgggtaacttatttgtgactagtttattcttttgaaatgttccaggtgggaaaaagaaattgatgcattgtgtgtatggtccctagggacaacatcttaattgagtggtaaaagttatagagaagcagattctggctcaacgtaagcagacagaggtgtgtaacacaaatatgaggttgaaccgtatgaaactgttgccttttaggggtaaaaaatggcccccaccgggtccagtggctcacgcttgtaatcccagcactttgggaggccaaggtgggcagatcacgaggtcaggagatcaagaccagcctggccaacacagtgaaaccctgtctctactaaaaacacaaaaattcactgggcgtggtggcgggcgcctgtaatcccagctactcaggaggctgaggcaggagaatcgcttgaacccaggaggcagaggttgcagtgagccgagatcgtgccactgcattccagtctaggtgacaagaggtagactccgtcttaaaaaaaaaaaaaaaaaaaaaaggccccaaatagcaatacttccatatgataacataaacacaaaactatctataatatatatactaagtactatatattgagtacttaccaagtggtggacactgtattaatccctttatatatattctcactttattctattataacctccgaataaacaatttattattcccattttatgcaggtttacaaaaagttaaataactcccctgagttaatttgcaaataggaggcaaagtctaaactggtcctgtctgacttcaaaggactgactcttattaattatgttatatatttatatattatgttatctagatacagaacttaggtggtgagttagggtcactgaagtggagatagttattaataatcccatttcacacataaaacaaactgaggacagaaatctttagttttttgtccattttcacttgttatgtgaccaaagggaaaatattagaatagctcactctcttcccctgggtatcagcatgttgcgtggaggaggtactggctgcgtttcactaaggaatcctttataggtgggtgtgaacagagagccacagaaatatgttgaataggagtttcagtttcctgttggtgacactaacatgctatctgggtcatcttccttctgatcgaatagggaaggacctttgtttgaatctcagtagacagaggccacgacttgtttgagagtgtaaatgcatcattctgcaatctgaatattgtcctctcaggtgacaccctgcacggcggaaactctaccactagttaggttgctcacttcatttccaactgaaactcttacttagaagaagtatttccaccctgcctgaataatgccaattatctgtgacacaggggaaaagagtactttttctctacaaccagagcacaatattcacccaaacgctggaggagacacccatgtctgcaaataatctgcagcacccatatgaaagtctcataaacagagtttaggcaaataataaacaacattggcacagatcaggcctgaggacaggaatctggtggggagtgggataagggggtaagccatttcactgtgcatctcttacttcattggcttcatataagagcaaggcctgtttatggcaaaaaacataacaggacagaaagatatagaaaataaaaattgtaagttttccatccacatgccctattcaaaagtaaatactattaagtttttccaggttctttatagatttcccgtgtgtgtgtgtgtgtgtgtgtgtgtgtgtgtgtgtgtctatggggtgggaggggtgaataagactacattatgtgtactatactgtggcattcagccacagaaatttcttagtgggtggttctgttaaagtaataaatacacaggactataaaatgcttagcagatcccatccaaccaaaatgaaattcaaagtaggttaaaaaaataacaatttaaacagcctaggcattttgaacagttttattaatttcaaatcttttgaatgcttattattaaacgggaaagctttcattattgccccacatacttatcagggaaatgaaacctttcctttcacttgaagtgttttgacagaatttctgaaaacaagaaaggaagggcctccaggggaaagccagcacacccggcaaatgagattctggcactcctccttaggagagggtctattttcagtgagttacttactgtgcccagtagatatcacacaaaaccagactctgcaataaaaagctacagaagaccttatacgttgagttactttaggttttgtaaaaagttatagtggtctttaaagacatcttagacacatcaaaaaataattgataaacaataaatcaaataacaaaactaagctatactctttttctttttcttcttgtctttattttacagaaaggacttttgtggtaagaaatctaataaagtccggtggccaagtcatcctttattctaaatacacactctcggctgaaagtggctatagcacatgagggcccaaagtgttgacatcaagcttctggggctgggatacaccactgggccaagtggaccaccaaacacacagtgaaatcctcgggctttgatggggtctcaaatgaaccttctatcagaaactgcatgtacagatacagcttgactaactccttatacacaatggatagtctataaatatgcactgagtgaatgaataaatgattttgaaagtcagcatattgtcaagttgtcccctggtgacaggttacattcctaaggatactgaacagaaaaggggatgatatatggtgccaagaaagaagtagtaaggttatttaaagatcagcatcttctctggcccacagtaaaactgtataagtggattaaataaatctgcaaagaatccccaaaccttccactataccccaacagggtatggcttggttttgttatttattatttactatttgatttgtctaagatgtctttgaagaccactatgaatttttttaaaaacctaaaataattcaatattataaagtcctctgtagaaaagtcttccttattcattcttttgtcatcctcctctttttacccatggcatataaccagtgaagctcatatccctgccatgactttttcctcctcttgcacaacctacattcctgacaatcctgttaaactaatttgcactaaggtctaaatgactgacaccattgaacctattctatcaggattctttattttttaaaaaaacacacagacattcatcttcaatctttttaatgtctcaggatacttttatagccaggtgagccttccagtacctctgaaatcactgtgcagcatgacgacctctgtggctactcatacaacaggatttgcccatacctagagttatgcactggtctcacaccatttacagtgatcttaaactatactccttagccataatctgaggaaagaggaccaaaatatcagtttaattccaagctttggcttggccagaaggaaagcctcttctagataccctactgaaaacaagtcagttgtaggcacccactttatttacataacaaaagtcccatatatagtgcagtcagtcacaatacttaaaagattaagctgaggttgtaagagctgcaaacgctgtttccccatgctatgttacatagtaatctagaatatctgtggcccagatgtagactagttagcacttgttaggtataactatggtttgaagaattgcttgtagctaatcatgatacccatatctggcctgggatgtatattttgtagtggcttctctgaagggatttgcaaacagaattatttaaatatgcttatcattagcagtttaaaaaaatgacattttggcaggagattaatttttaacttggcagctgttttcagacagattgttgtcaggttattacagtgactaactttgaaggaaggaggaaatttatgggagattattaggttttcagaccttcaagcttgcaattcccaaaagaggcaaattttctgtcaacactgagatacggggcctcaaaaacgctgcaatgtttgcatctttgagacctgatttcaataataaccccacatgtcgagaactaaaaatattccttaaaagtgaaatattcttcaaatatactgttcaattgataaattggagatttatatggaagtacattacagaggagcaaggtaatatattggaaagggctctgaacagaaagtttggagacctgcattcaagtgctaactctgagaggattgctaacccggtgagcacctgcagacctcggcctcagtttcttcatctgttagataagagtatttacagaggatcattaaagtgttttggtgaaaagtccatgcacctctgaaaccagcccaagcagatcaagttttgcccaagttgtcctgtaatgtacacaaagaccacagggtgtctctctacctaatgcacagcctggaaacccacacacagttcctagatcccattgcccctaattttattgccttgactttcagtcaccattcattagaaagccgtgtcacctgaaagtccagacaataaacctgaggggcaataatgcaaaattatgtttggttattggctagcagaatagaaaagagaagggcttcttggagaaatctatttgaacacagctttgaatgtattagcaaatttctagtttataatataaagtaacaagtcacaaatcaaatttctatgaaacatcaggccacacgacagaaataccataaagtagtcaccaatattccatctgattccctctcatgaaaaagaaaccccagataattatacttcgagcattgtagaagtaagtcagattattctcaatcagaaaaagatgacccaagacaacaaactcacatcttagtttaacgtaaaaagctatcagaatatatactcttccaaaaatctaaaccataaccaaaatggaaatccaatctattttccaataataagaagcaagagtaaatttaaaaaaatatagaaaatgatttaaactttttatttatttttttattttttacaaacaggccatcagataagatgggtgaattcattaaaaagatcctcacttgaatgtcttacaggtcttaaactcaaataatgtttttcagttctccctttgggtgacataaatcataaatataagggcatgtaagactttataagactcaggataagatggtaggcatagttttgaaacacgacaaagaagccataccttgaaatcatatgtggcatctgggttttcatcacaggcaataacttctggtgccatccagtagggagttccaatgaaagtattcctcctgcccactgttcgatcaagctgagcactgactccaaagtccactatttaagaaaagacaagtaaataaagtctgtgatcataggttttagatagcgataaaatgaatgtgaattattttattgtggtaaaacataagtaacataaagtgtacaattttgaccattttcaaatgtacatttctggggcactaagcacatccacactgttgtgcaaccttcaccactgtccatctccagaatttctcatcttccccagctgaaactttgtacctattaaacaatagctcccaattcccccttgccccaacccctggcaattattctactttccatctctataaatttgactattctcactaccttgtataagtggaatcatacagtatttgtctttttgtgactggcttatttcagttagcataatatcatcaaggttcatccacgttgcagcatgtgttagaatttccttccttctcaaggttgaataatattccattgtgtgtatggaccacattttgtttatctgttcacctgttgatgggcacctgggttgcttctaccttttctatattgtgaatatgtttttaaactgcatgagaaatggatgaagtgtacccatgaggaaggcacaaagaattacatttgattacaccaaggcttcacagggaccaaaaataggtgttaaaaaaaagtaagcttggttgtcagaaagggtagtattttggggatacaagacaagtgattaaaagcaaaagtctgagtcagactgcctaagtttgtatctcatttctgccgctactagtggtatgacctagggctagtagatcaacctctctgagcttcggtttcctaatctgtaaaatgaggatgatgacatctacacagagttgctctgatgtttatgagagataatctatagaaaattgtcttgtacagggcctggcatataatatatactcaacaagtaactgttaattagtgaagtaagaatgctctcaggatagcttatctagttgatacatatataactgcttagcctacataatgtatacttttgtttttaaaagagaatattcatgaggtgagaaagtttggtcccaaatgttaactaagaaaaaaaatggaagtcatatatttcaacaaaaaggaagagcaaatgtttgggatataaacatagaagatgtttaaatctctttgaaaatatacaatcatatggacagcgattcttttctagatgacaagttacatatcctactggatatttgtcaattcatgctcttactcatatacatcaagcagtcaaatgcatgtggtaattctctatttgggcagtcccagatttgttgcggaaagagctctaacagatacgccaaagagaaggattctcccactgatggaagtgggggtaatcagtatgcacctaaagtagaatattaagtatccactttgcacgggagcccaaggtaataacaaaatcaatgtaaatataacttaaacctatgggaatatagcaggaattgattattctgaatatgcctgtgtatattttaatggaaaaaaattgggtcctagtgctctgttatagcagcaacagtataaacaaactgtaagatataggaggccatttcaaagtttgtcacttctaatctctgctgaaacaaaaaaatctcaattatttctatatattgattaagcaagtggttctgttcccacattatatataattcattcctcagaatgccttgagaaaatattttttaaaataggcaaagaaacattttcctttccatttttagggcaatgctctccaaatccacggtgacaaattaacattaatttttttagagctgttaatataatctcatcacttcctgcaattccaaggctcacaggattctgctcttacctagtttaacttctgcattttcagtcagcaagacattttgccctttaatatctcgatgaatcactttatgctggtgcaggtgactcagcccctggagtgatggagagttaagaagggttaataggaacataagccaagatgccaataaattattttgactgttaaggatccaaaaactttacactcacccagacatacttttcagaattataatcacatctttcatgtgctcatagtgctcttctaactgtaggcaattcatcaatataaattaaagtacccaggcagtccttgcaatgcatggtgctgtgtttaatgaaatgcttgcatattggatctgattatcaggtatcagggaaccacacaagtaattatacggttccaacatgaacatgagtttcagttaatactactgtgaaaagcgaagtttaaacagtttaaaatagaaccatctacacagtctctgtacagaaaactaacctgatttaactgaatccctgcaggatatttgaatttaaaagttaaaatttacattctgttatccaatttcattgaatgattgattgactgagacagagccttactctgtcgcccaggctggagtgcaatggcgtggtctgggctcactgcaacctctgtgtcttggattcaagcgactgcctcagcctccagagtagctgggattacaggtgcctgccaccacgccaggctaatttattttagtacagacagggtttcaccatgttggccaggctggtcttgaactcctgacctcaggtgatccattcacttcggcctcccaaagtgctgggaatccaggtgtgagccacagcacccggccttgttatacaattttaattaagcgaagtaaaatatttctcagaccagccaagaaatttcccattggctttacccattgtgccttacatttaaaaaggaatacagtttctatttcttttgttggcattcatcactgtcatttttagtttatgctagtttatgctatttgtgactttgtgctcattatgtgagaattattcagtgacaactaaacctgtttgtgttccatttcttcatgaattactctgtttttggcttctttgtggtgtgaattctttaacctacagacttactctaaagtagtcatatatttttcagataaattataatctaaaataatctaaaaatggagtcttaaagcaaattattttatgctaacacctgataattcaatgtatcgggtccccgagtgttctttattacctttaattttttgtgcttttcatcttctccacaacaacaaaatcatggtatgaaaaatgaggttgacaggaaaagaaacaaacctagatatctgaattctcttgtcaaagaaattcagcatgagagtacagaggtccaaaaagacccacatatacatttagagatatcagaaaacataaaccatgttatagaagggtttgaggcactggtttaggtcttaaaaaattgcctttcttatctgttcagtttgtcacagggtaggcatcaggggtttaaatgtgtggttttcacaaaatttatgtaccccataaatccttaagagagggactgaagatccctttccctctttcactactgaagtggttgaaagcagataccagagcatggaagtgagccaaaagttcttttaatgagatcatacaatgcatggaggtcacctccaaaacctcttgtggccagagacctttgggtgatcaaatgtctcttccagtgagtcatgtctgaaatgctggtatcatttcggagaatatactggaaaaaggaggaaagccattgtttccacacattgagaatgtgtgaaaggtattgagagatgctcatgtgatgaaacatccctgctgcttttagaaccatgaagattagatcaaatgactgatcctctgtagggttccccagcagtgcagaaaggcatattgggcagaaccagccctagagacctgacaggttcttggcagccactgagtggtcaggatgactaaataatccattatgctctatctgaatgagcaaaattttaagtcagaaattcaaagtaagtttgcacaatggcacatcaaaacagagataaacgtcagatgtgaaggaaatcagcagccaggcctccttgtttcccctcaaattttgtgttatgttctgtttaagaacacaaaacatataatttatatttttgcctatcccaagccatggatgtatgtgttttttcttaagtgctttaatttttatatttttcccatttatatctataacccagctggaataaatttttgaatatggtatgtagcaggtgtcaggtttcatgttttcttatggatattcaattgatcaagtactatttactgataaaagaaccctttcctttgacacagaccaggtatcatccatatgatgtgggtctgttcctggacccttgattctgttcctttggccattgtctaatcttgtaacaatactactctgtcttaatttattagtagctttataataaatcctgataactggtagcataaattctccagctttgctcttcttcttcaagattgccttggttattcttggccctttgcatttctatataatgtttgaaaatcagctttataaatttccacaaatatacctataggaattttaattggaagttcaatgaaaccatggatcaaactgggtagaaatgatgtctttagaatattgggtaatctgtgaaataatgtacacctccatttattaaggtcttctttaatatttctcagtgatattttgtagttttcaggatagaagtcattcacatcaatgttataattttaaaattccattttctatttgccttttgcctaatttggtttgcatttaatgaacagacatcgtcttcttatgccttccttcttttttaacttctatccatttcatccatccacccaaagcatacaatctatctctcaaaggcatatcttgaacacacagtaaaaaagttttaacttttgttgccttaaattaagaaggcagagcttataaataaataacaatggccaggaagatttaataagaatgctcagtagacatataataacctccatattagtaggaagggatgattaagctagtctgaatgaactaaaatatgcccagttactttcttcttcctgaactcagctcagcaaatatgatactattgtctagatttcctgattgggggatgtgtgggaaaactgggcaaacaggcagtcttgttcagctattttgattagtttaagtgattaggtcacaaagattttttttaaaggtaaaatcggttaaactaggttgtatgtataggaatgactaaagtcacacaatccttataaactttatatggtgggaaggtattacaccattagggataatatattaattgtgaactttcacaaacagataacttaaatgagtgattaaaatatctcataaaataattcatttcctaagtggaacactgtctttatgatctaaaatcaggtttctaattggaaacagcattgaaaatgaatcccttgttaagagaaatcacccaatgtcaacctaaatgaaaatatgctcatggcctatctccagaatggcgctcacttccatcagagcagaccttcacaccaaactaccactaccaccaccaccaccactgataggataaacttttaaagggtttttgatatgcttatgaatttcactagaaagtcagaaaaaaattcaatccctcataagatatcatgtgttgcttgaagactttgggaggtgggccagtccccactcgtaacctacccgtaagatttccctgcagatgtatgcaatccactcctctttcaacgtgttaccttttgtgttcttgatcaggtcggtgacagagccagcaccacaaaactccatcaccaactggcaaaggaagcaaacaagccattattttaatgatgcttcactgcttccattaagttggggtaagaaagcacaagcaattggctgctttggaatgccattcctgcaaagaaaaagttatcataaaacaatatataaaacacaagcttttaccttcatgtactcccaaaatgatataaaggaaacattatttttaaatttttcaacctgtaagttatatttgaaaattgaggaaactctccatattctaagtatttttttttaatgggagtaggtaggtgactcagacaaaattgagaatatctctgttttaactcagcagtcaaattttcacataaaagtaggattattcccctatcagaaagaactgtggttctctaggtgtcccaacttagggttacaaaagtgcacactgtttatgttactggtttgtaagtggcactgtaagctgtcagtgtgggaactatctgtttttaattaacttcagcgaatgttcccaggaggttggacacatcaaataaattcaataaacaataaactctaatttagcacctttcatgcaaaagctccaagcactctataaatataaactcattacactacttagcaacttataaaataggcagaaaataaacatcacccttactcaatggggatgtagagaccatttgagaaaaaagccatctatgtgcttttacatgcattttctaggcttagaaaaacacatccatttccagacttttaccttcaaaaatatcttcaacaaagatcaccttattaggtacttatatattttttataattatatgaaaagaattcagaataactagcaatcaattcctgacttagtagtagagacagaactaaaatggagccacaataaaaccacattgatggctttggctttgtccaaatctacattcctgatatcagcactatgtttccaggtcctaaaagatacctcatcaggctccaaaatcttcaggcagaaattatattttctttttctttgtatacctaatagaaactaaataaaatctcatgaaactcatttcatgagtgagtttccaaagcctgttctgacttgtcttcttatgattccacaacggctagggaaaccttcccaccttctccaagaagccaaggaagtttcaagacctataagtgcttatagggaaatttgggaagtgccacaagtagactacattccaaccagataaaagttgggaaattacaatatgtaatagcccagaaactatcaaagaccacaaaatcatgtcaaaaaggattcaatttcaagagactcccagtggtgaaagatgggataatctgagcatagataagaataatagctgtaatgtgtagaaacactttaaatgtgcttaattaaatgccttaacaaggtcatcccccaccacccaaagaatatgactggcactgttagaaaaaaataacaaactaactaagagctgacaaataaaaggaaagactgaagagtctatactgcctttttaatacaaatcttaccactgggtagttgaataataaaagagggaaagtttctgttcataaaaaagtaggtattccatctaataaatgaagaagacatagtagaagaatgccaccattttgtgcctcctaataagctagcagactcaggcagtgatcatcaatgactgttaacattttaaaaagtaaatagaaaaaaataaataaataaaaaagtaaatagaatttgccttttggtataagaacgcatattacctaggaagtagtactgccaaaaataaaaacagaaatctgaacctgatcaggcctctagctccagccactgatttacaggaaattcagaggactgaggaacatgtaacatcatgaggatacaatcaacaaaatctagaccaggatactagtcaagacaaagagttttttcaacacataaattgcaagggagaaaaaaagagacgcaaagaaaacttatagatttaaaaacacttagatacaccaacaaattgcaatgggtgcaccttatttagatattaatttttttaaaaaaagatatacacattttgagataattacaattctgaatacggacttagatatttgatgatactcaagaaatctggttaattttttttttgtttgagacagagtctcactgtgtcacccaggctggcgcgatctcggctcactgcaagctccacctcttgggttcacaccattctcctgcctcagcctctcgagtagctgggactacaggcacccgccatcacgcccggctaatttttttgtatttttagtagacacggggtttcaccatgttagccgggatggtctcgatctcctgactttgtgatccgcccgcctcggcctcccaaagtgttgggattacaggcgttgagccaccacacctggccagtattttaaaagtgtaataatggtactgtagttttgtaaaaagaagttcttatcttttagagaaaaatgctgaaatacttatggataaaattatatgacagtttcttctacaaatagtgctgagacaactggatattcacatgcaaaaaaatgatgttaaacctttacctcacaccctatacaaaaatattaactcaaaatggatcaaagacctaaatataagagctaacactatcaaactttcaggagaaaccataggggtaactctccttgaccttagatttagcaatggcttcttagatatgacaacaaatgcacaagcaccaaaataaaaaaaaaagaaaaaattaattttatcaaaattataagcatttgtgaatgaaaggacactatcaagactgtgaaaagacagcccacagaatgggaaaagtatttgcaaatcatatatctgataaaggtctactatccagaatatataaagaactcttacaactcaataacagaaagacaagcaacccaatttaaaaatgggcaaaggacttgaatagacattcctccaaagaagatatacaaatggctaacaatgacatgtagaaaggcttgatgtcattagtcattaggaaaatacaaaccaaaaccacaatgagatatcactttacatctactaggatggatgttaatttaagaagaaaaaaggcagaaaatcacaagtattggtgaggatgtggggaaactggaacctctatacattgctaatggtaatgtaaaatggtatagttactgcggtgaacagttaatgggttcctcaataagttacacacagaattgacacatgactcagcaattccacttctagaagtatactcaaaagaattgaaaacaggtgttcaaacaaaaacttgtacatgagtgttcaaagtagcactattcacaatagacaaaaagcagaaaaaaacaaaatgtctatcaacagaagaacaggtacacaaaatgtgggatatccatacaataaaatattattcagccatggaaaggaatgaaatactgatgcatgatatgtggatgaatcacgtaaaacattatgctaagtaaaagagaagccagactgaggcaggagaatggcttgaacccaggaggcggagcttgcagtgagccgagattgcaccactgtgctccagcctgggtgacagagccagactccgtctcaaaaaaaaaaaaagagaagccagacaaaaaaggccatatattgtatgattccatttacatgaaatatccaaaataggcaatccatagagacagaagcagactagtggatgccagggactgggtgtagggggtaacaggaatgactacttaatgggtacacagtgttctttcggggtgatggaaatgttctggcactagatactcatgatggttgcataacattgtgactatatttaatgataatgagttatacattctaaagtagttaaaatttaggtaaattttatgtttatgttaccaaaattttaaaaaatgacatgttttgtttcaaaataactagaaggggcaacatagatggacatgtggatggggtggaactggccactgattaaaggctgttggggctagttttgggtgcataggtgttcattatactgttctgcctatttttgtgtatttttaggattctccacaatacaaagttaaagaaagtcccattatatagcaaatcagggttcaatgccagcaggatggaccaaagaaacatcttttgatagcaggaaatgaatattttcccgagtgagcaaaacatgtttgtgtcccttctctaaatcccattttgaaaagtacattgaccaggcctcctgtgaatacatccattgctcctgtatcagctggggaaaatgtcccaccactgagctttattaggccatgtaattatagctcccaaggaaggcaatggaagcccagtgactcgagtctttcaaaattagattggacaacatactttcaaatattcagtaggaaacaatcctactctagccaggcactactgtcagtgatttctataatttgctttcccattcagctccagctgaaggctgctaaattcttttcctctcactatggaacaaaatgattgttaaattatataatgggatttaaaaaaaaaaaagaaaaaaaacagcacttgctagcaattggttcctacagccacacagcaatgctgataattaccgccaccacacagcagggatcctccctccccataagtaacctcatcacattaataaacagaaacagagctcaacatgccaagctcagcagtgataagtcaataacttcacatctcactagtaagaaataatgggtcattaaaattctccctgaaagaaagttctcaaagagtttatactgggataataatactttctaacatttactgagaatttaccatgtgccaggcactgggtgaagcgatttacaaatgcttcgttaattcttcttcacctaacttcctttttctgtatttggaaatagagcttacagtctgcactttatccatagtctacactcattaagtaacttgagcagggtgaaagcacgttgctctctcaattactagttatgtgtccttgggtatgttccctaaccaccctgggcttagcaatgtctctctccccaccactaccactatgataaaatacaaaataaaagcatcaaccttacaggtttgatgtgaacattaattgtgactatggatataatgctgctagcagccaaaaatctcaagatgtatttatgatgtttctattctttggtctattttgcatttataaaaatgcgaaaagaaagagtttctgacatggaagatagcatcaatacctccccagtgtccacttcacttggatggtgaagagacagggctgaaagatatttgtaaaaggcactgggcacatttttctaaaacctctattaatgaaaaagcaccagagacacatgtttttgtttttgtttttgttttacatttgtaccacacagcaagaagacacagtggtgcattccagggcaatggatctttttatttggaaggcaggggtgatagggggtggaggaattttaaaggaatctaacatttgaaattttcactcaacaccgcctaaataaataactgggtcagaaacttaaataaacatgcataccacttgagaagaaagaaggaaggtcaagttgaaggtggttgggggcaggatgaggactaggcctgagcctggaggaggtgtccaaaaaaagcacagtgtggagcaaccaacttattagagaaaagaattgcttggattatttagacatgggtaattattactatctaaataacaaaggttaatttttaaaagccaaagagttctgacacttcacaatttgcatggttgattgtcagcagtttttgtcagttgtcatgtttctcgtaggatgttttctcatagaggttggtcaggggttacttagtatgccttcctgtgcttctcccctctccaggacaatatttaagtaaagggtcctcagcctcagctgattccagaagacatttcagaatactgagtcagcgcttgaggttatctcttcacaagagacagggggcctttagcatggaatcaccagatgtggtggcttctaaacttccctttcctgccctaataacctctaaaagaattttaaaagatttagtctcaaaggcagtcaaaggtttggatgattcctggggtccctaaagtattcactcccttgctagtttattggttttaagttcctgtaatgagaaacgaactcttaggatgttatttcacaattgcagatacttacccagaataccctgacaggaactaattcctcccaaatgtcactagtcagtcacccacaagaataaatgactactaacagatcccttctcttttatggtaaaaggaggggttggaggcagggggcaggaagaggtgcaagcgggaagattaaggtcttcctaaagtgagaagggtttgcaccaagcagtttaaaaggcaccctaagaaaataataggggctgggcacagtggcttacgcctgtaatcccagcactttgggaggccgaggtgggcagatcacctgaggtcaggagttcaagaccagcctgaccaacatggagaaaccccatctctactaaaaatacagaattaggcaggcgtggtggtgcatgcctgtaatcccagctactcgggaggctgaggcaggagaattgcttgaacccaggctgcgaaggttgtggtgagccgagatcaagccatcgcactccagcctgggcaacaagagcgaaactccgtctcaaaataaataaataaataaatataaataaaaataaataataggaagaacaaacttccaagaacacaattctgcaaagatttaacccagaaacatcaatgaggcacagagtattttcatcatgtgtggctgaaaataaccacagatctcatctgcatgatttatgatggtggaaacaaagtccaaactcagtaactttggtacagaaggctgctttatgtgcaaaaggtaggttaagtctcaaaatataaaatgtgtgtatagaaatacaaaatacaaaaattggtaggtatacatttgaatacatgtatcatttcaatcaattgaagtaaagcttggggatttcaaaccttaaaaagcaactttaatggccttttacattcatttttaaactagcatgtactatctatctatctatatataaactcttggcttctgaattatatttttcgactgggaaagagaatgcttgaactataaattttaagacttccaaagacaaaaagatgagttccaaggatgggaagtgtcctagactttgtaataaagcttctggatagtgaacaactctctaccttgaacatggcaaagacagtttgaatataccgagccaactagtatttttagcaacaacaagtctgcccaaaggacaggcccactacaaatgctcaagtcgcctatgtctcaagagacagacaacccagagtcagtacgatagcatttaaagaaacgttacggacattagctgcatcttgtatttggtgtctggactcaaattccacagtatgaatgcaaaattttctgcatatatatatgttttttttttggtaggagtaagtcactacatgtcaattttgtccaaagatccaatcatagaagctaactttaaggttgaagaaatttgcaactctgcatctcggaatgttacacccaaatagaagaatgtggggtgaggaatggtgagccagttttcagacaggttgaaaataggaaaagaaaataaattgctagctttagagcatttaggactaatcatcttgattgctgaagattttgagaaacacaatataaataggaacatagactttggctcaaaagttatctaaaaaaaggaatcaaaagggttgtatggaccattagcaaaataactttgggtacatatcaagtcttccttttgcttagatgaaaagaagtttaaacaaagttcaaatgaaattctttgggacaaaagaagagatcaattgcacattcttatcaaagaatcacccattaattcataaaatagctctattaaagctcaacacacaccagttgcaaggtattaagttacgtgtagcttcagatctgtgtttgtatctacgtaacttaccttgtgtctctataggtcttgcaatgtggcagctctgaaactgggagactgtttacaatcattcctcttaccatgttaggcatatctatatttgccaaattcaaccttttaaaaatttctgctcacaaataacaagactaaataactcctccagacaagtgacgtaggctctgtatatgaaggaaaggagctgtttacttataaaagtaacaaacactaatcaaaacaagttttaaaagcctcatttctgatacacagcattaacaaaagataaattttaactgttcaaaggattcagctatgagtggttaattttttttttttcctacaacctccacgtcacacaagggtggttaaatttttaatggcattatctgcagtacctaacatttaaatgttaaaacaatcaaaattgaagtgggcattatttttaccaagccaagacgctataacaatgtaaatccaaaatactgcagaattaggtttaggagttgtggccaacatcaatgcagagtctaaaaaggacctttcatgggtagttgaatgagtttgtttcttagttcatcccagtatcttattctgagacgatcttacacaggggctgggcaagtaatgtgaatacatgaaattgagtatgtatggaagacaacaggggatgttggggcctctggtgcaaatttgatatgtgccctctaaacagctggtacactgctctaaaatactgctactatttgaaatttcaggcccaatatttctagatcattttatttttcaaaacttttcaagaatccagacttttctgtgaaactgctcaaattttctaatgttggcataattaaaccaccaccaccttatgtgaaccaaactcaacatatttatcatggcagcatttagcctctaggctgccagtttgccaactaagaactagtctaatattatcatttttataaagtagaatccaaatgccagacacattggttctcccgaggtttgactctgggtctccagattcccaggctgtcagaatctttgtccttaaaacgcacacggtataatttcttaagtcttggctctgcaagtgtaccgtgtgaaaacttgatgaatagattattgagccgctacagggcaaaaatctgctatcttacttgaccaccctacatttcagaagatgattacaaatttatttcctgttacgagatattctagccctgtattatggtggtatcaaaaaagacagcaaaatatgtgtgagttcacattgtaatttttgagaaattagttaatttactaaacagtatttctccctccctcccagtgtctgaatggcatgcagcaaaatggagagcctctcatcactgataggcagcagaatgagatgttgtgtgtcagagcttgccttgtttccgagagatcagaatctttattgaaagggctcccttttttgatttccggatcagaccctgagcagttgataaaggagaattacttggccattatctgaagtagttgtatttccacaaagagctagtgctaaacaagagtttatctctacaacaagactgataggattcgtacagattataattcaatcagacacctgaaacaggacatacattggctagtgggatatatgcaaacctgtcctccagccatagcaaaataaatatctggggaatatttcatgtagtctgaatacagagaataaatgttagaaagtgctgcttttagttgctttaggccatgcctctatataattcataatatttttatacaaacgtaatcctaacaaaatgccactagtctgaagagtcaactatctatgacctttgcaattatttgataaaacattcccaaagcacctaacgcacttttcaaaatgtatttcttagagtttacagcactcttattagtagctaacaggtcttacttgctctttgaatattgggtaaatagaggagtacagattaaaggtgaagttaaactaaatttatttaaacataaatcttcaatcctatttagaacatcagcttctgatatcagaactatttttcatgaccaaaggagaagagtgtagggtttaagggcttgattctggaatcagacagcttggggttagctagcatgctggcttcatcacggacttgctataagaccttggacaaacttctggactctctgagcctagtttcctccatctgcagagtagggataatacttgatttgcagaatggctgcaaaaatctaataagataatatgacaaagtaaacaagcatagtacttggcccatggtaagcaggtgataaatatttcctaccattgttcttattaacagagaatgccccaaatttagtgagtcagaggccttggaataagtatgtactgttatattctatgactgtgttcccaccaatattgtaatctgatattaatttcctaactattatgtttctgtctttcttcttcctagttctttcttgatttgtcaccacatcaatcaactaggaaaagaaatgacgctcttgcccttatgaggcctttcatagcttttatcttcatctttggtaagaaagaagctactagacaattgctagaagggatggtcagagcagccctctgcatagacgcgagtctgacgagtgctaggccctttgtccttcaaacctggcagaatgtaggagctgtaacttccacattttgttacctgcagttaattgcatttaattgaagtggggtaagttgaatgtgatggcagaattcctccccatgtggtccagtttggaagtgctcactacttgcagatccccccttcatcaagttcaggaaggggattcacttactaaaacagtttcctaactggtctcctgtttctctccttgacccatctggtctattcgcaagccagcaactgaagtgaccccttcagtatgtgggtcagatcccatccccctcactccatgttcaaaaccctccatggctctcccacctaatgcagagtaaaagccgaggtctttccaatggcctgcaaagccctgaatgatctggatccaggttgcagactgttaacttctcagaaagacagcaagggagctctctgggttctttttatgagggcactaatcccatttataagggctccaccctcatcacctgatcacctgccaaaggcctcacctcctaataccatcacattgaaagttaggatttcaatatatgaattttgggggcacacaaatgtttagtccataacacattgcaacccttacctgcattcccaattagtactccaccaggtacttactagcttccagcatcctctgtaattgtcttatttattatgtttattgtttgtagtctacagcaagaatgtaagctgcattaaaataagtactttcataaattttgttcactgttatatcctgagtgcttggaagagtgccttgtgcctagccagtatatatatgtatctatactagccatgtatatatatgatgatatgataatatatacatatacatatgtatgtacacacagacaaataaatgaatatatggagatatatatgttcgtgtatatatatatatatatatggaagaatgaatgaatgactggggagtaaataaatgaacacatacacatcaggcttttggttcccagcaacaacagccatctccatgagaagagcaattggccagggtgagaactagtgggaagtgactcatttccagagtacaatacctcccattaacaccatgcagatgccagcaggtgtgctgctttctccaagtacctatctgaaaatggactgaagattttgctcagtttttaacaaaaacttccagggggctttcacagaacttccaaccaagctaaagtgttatgttttaggatgtctgcaatctggtcctgcatcatccactaatgagttttgaggcccggggaaagtcaattaacttcactggacccagcaaagtttatcatgactaattcttcttccaacttaaaacatctcaggatctgcaaaagggcgaaaaagagtcaagccctattaaccacccctctccttccctcaaccaacgattcgtaaataaacaccccaattaccccaattttaataattcaacttaacatgaaaaccaacttttctatctggcccatctcacaaaatgaatgaaattaatagctaggtgtggctcatctagaaatagctgttctagctcaggtgatatgctgggagatggttataaatctacattaatgctttttttttttaaattgagaaccatagccctgaccaaagaaaacacctttctacagacaactataaaatagctatcattccttggctattctaaatattgctgcaatgaacacaggagctcagatgcctctttgagatactgattttatttcctttggatatatatccagaggtggggcttctggatcataaggtagttctatttccaattttttcagaaacctctgtagtattttccacatggctgtaccaatttacatttccaccaacagcatacaagggttcccttctctctacatcctcaccaacaatatacaaattctttttctttttttttaaattttaatttttttggtagagatgaggcctcactatgttacccacgctggtctcagactcttgggctcaagcaaccctcccagccttggtctccaaaagtactgggataatagacatgagccaccatgcccagccaatatacagtttttatttgttgattatatcttaatacaactgggagaaaaaaagtcaggatacccgttttccttgaggtggcagtgattgagagggagagcaagggggacttccagggtgctgataatgagctggaggataatagctatcattctctacgtgtcatctgctgcagcttctggcaattcagagtcactgctaaaatgctaaattgttgacaatgtagaagtcctttggaaacacaaagatatgttaactcatgccaccccatcatatcctgttgaatctgcaggcctcagggaatctgagctctcaaaagtacctgttgcaaccaggttttgttctaacaatataattttcattcataaaccaatgattttgtcagcatattacccagtgccttccaaatgctgcagagggaagcaaaagacacaatccttgccctcagagagcagacagtcttttatgaggagcaagaacagcccggtggtagcaataacaaaagcagcagcagaaagggttcagatgctgaacttaagagaaatttcaggccaggtgcagtggcttgcacctgtaatcccagtactttgggaggccaaggcaggagaattgcttgagactgggagtttgagaccagcctaggcaagaaagtgagacaaaaaaataaataaattagctgggcatagtggcgtgctcttgcagtcagagctactcagaaggctgaggcagcaggatcgcttgagctatggtatttacggctacagtgagctatcacggtgccaccgcactccagcctggaggacagagcaagaccctgtctctaaaaaaaatgtactgaagagaaagattagagaaaaaaaaagcagatgtaaaaaagaaaaatgcttttaaaatgaaattactgaaattactacctcaaatattttcaacacaattagtatacattatatcagatatccccaccaagttactacgtattttttccacaaaaatgaaaacatactatatctaattataacctcttcaacaggctttacaaagtcctattttatttttgtgtgtatgtgtgtgtgtgtgagacagagtctcactctgtcacacaggctggcgtgcagtgacactatctcggcttactgcaacctccgcctcccaagttcaagcaattctcctgcctcagcctctggagtagctggaattacaggcagccaccaccatgcccacctaatttttttgtatttttaatagagatagggtttcaccatgttggtcaggctggtctcaaactcctgacctcaagtgatccacccacctcagcctcccaaagtgctgggattacaggcgtgagccaccctcgcacccagcccctactaaaattgttaatgcttatccatttataaatgcagagctacatcattttaaatgtctgcaatgtcccgtaagtgactccctattggttaacttctacatacatccttatgtagttacctaaataagtgacctgatttaggacatattcctgcctgtgaaaatagggagtcaaaagtaaggtgtttgctttggaaggggtgtgtgtgtgtgtgtgtgtgtgtgtgtgtgtgtatgccaactgcccttaagttggaccagtgttcattccatgagcagtgggtatgagtgtccattctagacattataattaaaaaaaaatctttgacagcctactaggcaagaaatggtatctatttttttcttgtggatttctattgttagtaagaataggcttttaatacaactttactgataattgatattgcttacttttttggttgtaaccatttccttaactcaatcttgctattagtaatttcatgtttttcctattgatttataaaaatgcttcatctctgaaggctgctaaattctttgctcattatattataaaatgaatatttttacttagttatttgcatttttactttatgttttttgttaagaagacatttaaaacatgtatatagtcaagtccatcaaaattatattttatggtgtatccctttgttgtcatatatctctctttaggattatccagtcatatttattttctcccactacttttatatgttgaatcttcatatttacatctattatacatttagaggccacaattaaaacctactgtaacttttttagaattatataaactatataaaatgtgtttacccccaaataatttttcttttaaatttggagatgagccttatggaaaaaaaaaatcccaatggttcttttcatttccaaagattgagtactcatattaaatgacatgaaaatcttgttagttttatgagctaacatttttatatcttttttggtcactgattgcattcactgtctatattctgtcttccccactggattggaaatgtctgatgcattaaaatagttacttctgcccgaggctgagtactttgggaattctccatgaaatagccattactggatccacacagctcagcacagtatttggcatatagtaggctcttgctaattcagtaaattttgtgtgttaggcacatacaaaacctctggaaaatgagcaagacagtaagaggttaaaaaggtatttttagaagcattaatataacaacgacatgtgggatgaacagaaattgagagagaggaagcggggaaggagggacggaaggacagaaggtagagggaagaagaaagagtgaaagaaaagtagatcaacacataggaggccattgtaaagtccaggcttccactgaatgggcccatactagggaggtaattataaaattggcaagggaaggccaaaccaatacagcattataatcttgctgaaggactaagtgaataaaagttccaaggacagaaaccaggaaggctccgcacagcagcaacaggctttggtatcaaacacagtaaactcattggtgggacagccaattagagctgcctcttagactgtcaaagataaaggactgtggcacatacctaagtggactaggggaaacatgaaaggaaaacaacctttgcagagtccctacttggtaccagacactgtattaggtattttacttacagagttaaagtttatgtttcagtcgcccactcatcagcgatagacagagaatcgcatagagcttggttagatcctagatccatccctgctagctatgtagactttggaacagtttattcattttttctgtaaaccttagttgcatcattcaagaaattagggaaagaataatacctaactcaaagaagcaaaataaatgatacaattcataaaatgtaaataccaaggcacctaaaataaaacacaataaaaggttgtcaattagtgaaaaaaaaaaaaaaaaacagagaacttaacaattggctttggggatggtccatattaagggatagaaggaacatttagagatcctgaaaagacagatattcaaggaaatgggagaaaaccctgaaaacaatatgttacggacatcatgggggctaatggttaaagaaggagttaatcaaattttgtcatgaggatagaaaaatgaaccatttggccgtgtttgttttttatgtaaataaagcaaatttggacggcagtacatacccaaagttggtcatccatgcctggtgggttctttttgataaaagcaccatagtatgtagcaatattccggtgatgagaatatttcttcaacatgttaatttcttgtttgatttcttcctcttcatcctgtatgagaacaatataaaaattctgtcatgaaaatctatggttgttagtaggattctgttcttcaacaccatctaaattttttcttgttttttcttccttgttgacaaatgagcataattattacatatgagggcaaagaacaattctaaaacataatacattggctgtccaagagactcttctttttgtacagcaaactggcatagcacaatctcttggaaaacaaaacaaaaacatccaaaacaatccctcatctcttcacctagaagagatcaaggtagaaagactatcgagagaaaattcactgtaggcctctgggaactacatccatcaagtagctattactgattctatctggtataagaaagattgaggaaaatgaaagatattaaaaccgtgggcgctcagatttaaattttgttaggttcattttctttgaaggctcctttcattgaagtacctgactgaagatgatgaaagtcagatgggaaaaggagcaaaggtaagttctctagatctaaggaagttcacaaagcaggagtacccacctcaccttcaggaaactcaccttagaaagaaagggggaaatgtggtggtactgaggatgtaaaaagagacaactctcttacagagttagtttcttaatattcaggtttcattcactatgaattttgatttggagtccaccaacctggacccttttcagaggtcctggcagtgctggtggagatggtgacctcccataattttattttcttgatgtgtatacacattggttggactgcagaagagtgttttattgttgaggttgggggagaaagtttctacctcaggataattttttaggtgcagcagtaagctatgactgtccctgagtgcaagatgtgacattatcatgacctgaaaaactacccatggtgtcccctgtctgtaccctcctccactccggctgcactgcctccttccagtgtctctgcattactgggacttcctgcagtctctcgtgtgctgtcttctttcccccacctcttcttcacataagctctactcaccattcctgattgagtttaatcgacattcaccagggatctcttccttaattctctcaggcaatgtcaagtccccccactgcatctggtcatagcccctacactccttcacatacctgctgtatttgttgacattggtatggaggtatgtcccattactcgactctcttctccctatattgtaagctctcctctccagatcttcagatctcagttctacagttccttccccagcaaagctccctgatctgcccagtttggttctagccccgtgaatcatcatgtatcttttcctttgtagcacctatcagaattgccacccacatttatcatttgattaaggtctcctctccttatcagtcggtaagaaccgtaaactcaggaatcctccctgttttgttctctacaacatccctagcaccaagcagtgcctgtgaataaatgcaactaaaagaacaaataactacaaagagcccaatgcccagagcagcattagtgatgttagaaggaacaggtaagaatagagtgaggagaatagtgaagtgctgacatttgctgaccatgcttatttactaaaataagctttaggaaaaaacaaaggggatttgcaaacctaggagaagtaaaagcatgttacatatcacatggcttaactaagctgaagactaggtaatctcaaaatagaatatatgcttgggatgctgagctaaggagaagcatgtggccgaaacagtggggaagggagtcaaggggcgagacaggggaaggcacactgctgaccacctattcttcttagcagccatcagaaactccccacgccttcactgcaggtcgtgaagagaatgaccttcgccagccctcaacttgttgaagggtccctacagcgcacctccaatgtcttactatggtgcacattggctatttttaaacttgctgtatggggccaaataattgtggacgaatgtaggatgtgagcggatgtactttggggaagcctaaatagaaagggagaaaaacgacctgagggtttctgtgggcagcacagcatcgacagctgcttccattaaaaaggcaactacgtgaggtaataaaagacacggatcactttccaactgcagcctgtcaatcttagcatcagtcattcttagtgagaaatcaggctgcttctacaagtatttaccgcttgcctcctggattcttagcaggatagtgggtgatgtgggaaagacaggggagggggggactgcctataaaaagctcaccatgtcattaagaaaataagagcttataaaacagttaaataacaacagaaggcactatgtaattaaatccaaaataaatagtactggaggtcagaataaagtcagtacattctccatcattttgcaaaggtaaactgaggcaatatgacaataaggacagcatatgcattgagtctgggatcagaaagaagagggtgggcagatggggtgcatgttgagtttgggtaccattcctttctggctgcagaatcccaagaaagttgcctatctttttggaccctaagttttctcatttataatgagataaagatattataagtcccagcattttgtggtacttagataacggatgtatgttataaagtgtactacaaagtaaatgttattactaatctacataaccaaaaaataaataaataaaagggcaggaaggccaaaatgtaaatcacttgaattttaggtttaaattgcactgtttccaaacacagttatggaaccactgtaagacatggttaggtagttctaaaatataaatccttgatcttacgcaactttttaagtcagcatgcaatttagcaggcctttgggcctactgtttatccagatttttagtctagggcacagatggcagtaagttattcagtgaaataggaaggaagaccgttactagatgagacaagaactcatttaaccatgtcacaaagagttcagcctctcacaatatggcccatcaagggagatgagttacaatgctttccaaaaatgcaaagagagcaagggaggctagaattaaactaaaaagttataagtgaaaaagttatagccccatgaatcatcatgtatcttttcctttgtagcacctatcagaattgccacccacagtggcagaattgccactgaatgtggcaaaaagtaggagacaatttatcataaaggatcacaggctacgagaatttgaatagcctctatttgtaaattattttgtaaatgtactatttccaaatcttaagtattaagcacaaggatcaagccctctgataaactaatgaccactgggcaataatgaaaaataaagtagtggtaccaaattatcacacatttaaaagagtaacttcaataagccaagtccggtactctaggaagaaggattacttaaatcagatgacttccaaatccagtcatattcattatgttaacctcagccatggcatttaaactctccaaatgtcagtcattttcagctataaataggaataagaatacctatataagctacttctcagggcttagaaatgattaagtgcttatttaaatgtagctttagtattaatataaagaagataatattatttctcaagatcacaggatctacttattgcttagtgtttgtggtagactgaaaaagaaaatggccatgatatgtgtcccacctgcatcaagaggtggagtccatttctcttctccttgaacctgggcttagccacatgtcttgctttggtcaaggggacattagcaaatcggatgaagaagcagaggcccgaaaagcacttatgccttgagactggccctctcctactgcttgccagagaaccaacccttcaacccccatgtgagaaaccgggattgaccttctagaagatgagaaatcatgggaagataggcagttttcaaatgcaaggaaatagataattccagttaatgcttttaagccactgaccacctctgatggcaacatgattgtcatcatgtggtcataaaacatagccaaagccaaaacctcatgtaatgtttactgtgtaccaggaggtatgtatgaactatcttattgagcactcagaacagctatgaagctggatcctattttacaaacgagtaaaatgagtctcagagaagttaagtaactttcccaagttcactcatactttaaatgttaaacctcagattcaagaccagatttctctgactccaaagccagtattcttaattctttacagaaaactactagtcagatgaagggcaattatccatggtgtccaaaaccaaagtcgttaatcggaagcgtttaagagcatcttaagccagggcagaagagaaccctgactttggtcttccaattaaaggagcttgttagcatacaataatatttgcttatgattgatttcaaggaataaagaagggattttaagttgcatatttattacacaggggaacacactttaagtgcctatgatatgctagcatttaaaaatggaataaaacatttaatattagttatatgctctgtaataaagtctgcccaacatttaactctcaatccgtggcagaggaatgaaactatgcaattcctacagcaagtctaagagactagtcaggaagaagtctagagagaagtataaggtgtatagattcataaatgccactatcccatagatgtgtggacactggctagaaccatctctgctcccgctcatctgcactgctttcacagcagctgttgccattaagcaggtgtttgtgttatctgtcattctcaccttcagcattgactgaatgtggcaaaaagtaggagacactttatcattaaaggatcacaggctacgagaatttgaagggatcgtcactatgatatagaatgtggtttttaaaaagcttctgaaataatttgtaatagtgaaatccctccctgcaatagaagtttttttcaggatgcaaatatatagctgacaaaaactaaatttttaaaatcagtaaacatttatttgtttaaagcaatatctacttatacaattagtcaatgacaagaagttgttctagtgaatacaaaattagaaagaaatttaaagttatacatcaactctaatatcttattaattttcatttttctttcagttctataggatggagaaaaatctgcatttcctaagataaatagttgaaatagttaagagcatgccttgaaattttagtaggatcttcacaatcaatgccattctgcacatgaatagggtaacctagcagcacaaattaacaggctggcgttttccagtgtgttcaaagttggtgtataacatacagtttgaggtctgctttttaaatcacagtttattatatgttaaaatatatttaaaattaaatgagaattaaacatgtaaatcacctaaaattatctcagggtcaagttatgcagctttgggtctgtttccttaaatcgattacatctaacagactgtaataaattagattgtaataaataattacaatagattgtaataaataattagatgtaataaatctattacatcaaatagttttaaggaaacagacccagagtcatccaacgagttgtctaagtccctacctcttcattttagcattgataggactttgccaggacattctgcaggcagcacctggatttgctgtatatgttaactctaagttaaattaattcattcaagaatgatttactcaacccagcaaacccattactaggtatatatccaaaagcaaacaaatcattctgccaaaaaaatacttgcactcacatgttcaccgcagcactattcacaatagcaaagacatggaatcaaccttggtacccatcaatggtggactgggtaaagaaaatatggtatgcatacaccatgcaatactatgcagccataaaaatgaatggaatcatgtccttttcagtaacatggttgagctagaggctattatcctaaagaaattaatgcaaaaacaggaaacaaaatcctgcatgttctcacttatgaatgggtgctaagcattgggtacagatggacataaagatgagaacaatagacactgggactactagactggggagagaagtggacaagagttaaaactgactgttaggtactatggtcagtacctgggtgacagaatcatttgtcacaaacctcaacatcacacaacatacccaagcatcaaacctgcacatgtacctcctgagtctaaaataacagttgcaaaaaaaaagtaaagaagaaaaaagaattatttactaagtgcctactatattccagtcataattgtaaatgtcaataatataatcatactacaataggcataacagattcaagttctgctacaatgaagcttactacagtttagtggaagacacagatatgaatcaaagaatgagatatatgcaaaattacgaccatgagaagtatgtggtagctgatctaattaacctcaagaaacctaagtttaagctgagtttttaaggctaggtgaaagttacccaattgggaagaaaaaaagagaaaatgtgatgtagtgtgattgggatagaaacattttcctggcagagaaagtgtttgccaaggtcgtgtggctggagaggatgtagcatgtggtctactttggaggcttttggtgccataaagagaaaaataaaaattgtctgcaaaagacctggtaataataacaacaataggcacagaataccgtgttctacatattgttctgaaaccctttataaataatgattaatatatttacatctcacactaactttgtgagagaagtggcattatccacatttatagatgtagaataaagaacattaagcaatatgtccagggtcagagagccatgaagtgtcagaactaggatattccacgagactgacactgtgcagggctcttctttgccagtaggctaacctgctttctcttacaatgaagtggagttccctaaaggggtagataacaaaaggttgacatatgtctttctcatacccaagcctgcactgaggcatgactcccaagaaaaccacgaattaacaagacccaaactcaagtaacccagaagtaaacaagttttaaacctagcaataatgtcactcatgtggctaaagtctaccataaatggcgtggcttatatcttcaaggatcctagatttacaattcaggtaacagcccacaggaattggaatgagtttttttttttttttctgatagtataaacagtgtactttataatgttccccccttttggctttggttattgggaaaaataactagcaagttctctgtggccctgtaatttcaatttgcttttccttcaactggctttctaatcttaatattgtttttatatttatttttacataaatatgcatttatactctacatagatttttacattgtatacactatatatgcattatatattatatacatgtattatatgcatatcatttacatattatatattaaatacatatttttatatattataaatatatatttgatatatattacatatatttaatataaatatattttatttttatatattatatatttacatatttatattaaatatatatttttatatgttttatatatatttaatatataataaatattaaatatttatatttatatttatattaaattattacatattaatatataaaatattactatattagtgtattaattatattaaattatatttaatataatatattaaatatataaatatatattttatataaatatataattataaatatatattttatataaatatataattataaatatatattataaaatatataatacatattcatataatcattcaataatcatttactcaacccagcaaacccattactaaattatatatattattataattatatgtaatatataatttagtaataattataatatatattatatataatgatatatatcattttatatatataatgatgtgtatatatataatgatatatatcattttatatataatgatgtgtatatatatataatgatatacatataatacacatatataacacataatgcagcacctactaggtgccagtgccagtgccaggttcaaccttagcaagctctgcatggggtgcaaagatggataatgcacagttcctgtccctggccttgaaagcttattaaagtcagtaggcttcaaatgagaaagaacttttaatgaaggaaaaataaaagtgggtgaaggatatgaacagacacttctcaaaagaagacatttatgcaaccaacagacatatgaataaatgctcatcatcactggtcattagagaaatgcaaatcaaaaccacaatgagataccatctcatgccagttagcatgacgatcattaaaaagtcaggaaacaatagatgctggagaggatgtggagaaacaagaaagcttttacactgttggtgggagtgtaaattagtttgaccgttgtggaagacagtgtggcaattcctcaaggatctagaactagaaataccatttgacccagcaatcccattactgggtatatacccaaaggattataaatcattctactgtaaagacacatgcacatgtatgtttattgtggcactgttcataatagcaaagacttggagccaacccaaatgcccatcaatgatagactggataaagaaaatgtggcacatatacaccatggaatgctacacagccataagaaaggatgagttcatgtcctttgcagggacatgggtgaagctggaaaccatcattctcagcaaactaacacaagaacagaaaaccaaacactgcatgatctcactcataagcgggagttgaacaatgagaacgcaaggacacagggaggagaatatcacacaatggggcctgtcgtggggtggcgggcaaggggagggagagcattaggagaaacacctaatgtagatgacaggttgatgggtgcagcaaaccaccatggcacgtgtatacctatgtagcaaacctgcatgttctgcacatgtaccccagaacttaaagtataatgaaaaataaatgaataaaaataaaagctgaacttcccaagtcattaaatagaaattcaaaatactgatgaggaagtcaaatcaaagaagagcaacagagctcaacaagagaagacctagtgaagtcaaaagaggggaatgaatatgaggtgggaagtgttggcagcataaaggaaaggacggacctgcagaaggagaccttgtgttccactactgaggaacttgattggaaatcatgctttgaacagccccgtcagtgattccaagcaccccagtttctgtatgccaattttgtcatctacaggcatctccaccccactagggggctaagggaattaattataattttgatcaagtgctttgaggtacacaaataaaaggaccagtgaatataaactattatgatgtaaaaaatatttttaaaaactattgctcacctttattagtttggaggtatagacagtagcccccaggcctattttttgcacttaagcaatgtatctaacatgtgagcatacacatacaacaagcccaacatccaggccatacacacagcatgcatgaacatgcgcagagacccagacacacataagccaccaaaagggtctaatctgtatgcaagaagaggacagatgctaaagtgtgcatggagtgggcagctcagttgttcatttttagaaccctagaagctttccaagttctacatgctgtatagcatacagaattgaagcactgaaaatagccccaaaggtggagggtattaggaagacaaaaaaagccatttgtttatcttttctctgttgaaagttttgaccatgtgcttgatcagactgttctgtctgctaaagacatctacataaatggctccaaagtaaaagtcccaaagagctgtccagagggcctctgtggcaaaggagcttcagatgggaatccccaagctttgctgacatcacctgaaggtcaagctcccaaatctggaggtgcacctcccctaccccttcacttggctaacgaaggtctactcgtcctgtagatctcacatagctgtcactttctcagaaatcatttattggccacccagctaggtcagtttcttcttaaattctctcttcatactctgtacactgcttggaagttaatcagaattgtgactgctattgtttaactgctaaatgtcttgtactaaaatataagattccagaagatagtgcccatgtctgtcttgttcactggatgactccgtagcacagtgcactcattcattctcaagtaaatgaatgaatgaaatcttgtgatttcagccttcagcctctggaatctagcttcactttctttcctggatcctgctctagtaagccattttttttcagctacatactattcagggtaaggctaacaactctgtaattgaggtggtaaagatagggtgagtgcaaactatttacccatatcagcaattaactaacacaaattggcacgtagttcacagatcaggctgtcatcaaaatatacaactacaggattttaatgcacactaaaatcttttcattcctattgtctgtcttattcagtgattcaatgtaccttactggcactaaccattaaaatcatgtattgaggacctattatgtgtcaggtacaagatatatcccatttaagtcccaaaacaagcttgcaacattaaccaataagaaaactgtggctcagaaaagttaaaatttgcccaaggtcacaatcagtaaggagatgagtggaatataagcccagctctctctgaatctgaaggccatgctctggcaatactctctcatttctcatcctataataagatgtctgtggagagtgtgggtatgccctgactggctcgatttgaattccaaccctgccatttactatccatgaggcttgggcaagtttcttgggctctctgctgtcaattcctttgtaaaatagatataccagcagtattctcctaatggacgttgttttaaggattaaatgagtactaagtactcatttaagtactaagtacaatgcttgggacatgataaacaatcagtattagcccctttttggcctgtgcctatcgtcattattattattaacaatattatgtgcatactattaattatgccactgaactgcctccctttgggatgaaagaaccaaatgtacttggaacaatgtgtccaccttactcttccaaacaacccaagatgaaaagatttttcttttctttttgtgcaatttcagcaagcattcactgagccctttaataatgggcaaaacagtctactactgggagaagaccacttccttactcttcagaaagagatggaggctggtcataagcttcacctacagaaattcagtaagacagaaataggaattcagtgaagcagagcttagcatggatcctcctagtaggcaatcctacggtgttactctcctgttcaacttctggctcttgcattggctctagtagtagtttgaggaaaggagccaggacttacggtctcccacccttggtttaaaaaaagaaaagaaaagaaaagaaaacctgcttacatttcttttatgtattgggtttttctctaagtctatttgatcaaagtgttctactgagaaaactaaaaattaaaaaccttgtaaactccttgtcacagtattaaattccttcatgacctggcccctcctaatgtgtctagattcatcttgtatcaacgccttcttggcacttttaacctcgaaactaagctatgtgcagtttccagaacatgccctctcagcctcatgccttggcaccggctgtattcttggctggaatgtcctcacctgactgtcctcctgggcttcctcagtgaggactgtctcctcacagttccgacaaactttacaagtaacgttatttacacattctacagccttgttataaagtgtataagctttatttataaatatttagggcaaggttgtgttactgtgagcaggcaaaagaccatttttttcatctttaaatttccagtgcctatcataaagtagattttagtaaatgtttgttgaataaatcaatgaaaaaagaatcacatgaaattaaacactacatgaattgaagactgaaaacaatgtggttaagaggatagacttaaaggatggggttacattgctcaggctgaaatattcactccttcctttggcagccatgttacattgagcaagatacttaaaatgcctggctttcacatcctaaaatggggctaatcatggaacctgcttggttagctgctgaaaggatcaaatgaattaatatatagaaagtattttaaagagttctggcacgtagtaatcactcacttagtgttagctaccattattattctttttgataggaatataaaaaatgtaattagagaaacactttacttaaggaccaaatcagttttgaacacactcactataatatatgatattatagtcatagaattctcctgtttttgcccacccagcatctttcccactcttttctataataactctcaggtttttctttgagaaatcaactctctccaactctcagtccctgcggtaggttccagagccaggcatccagcccaggcgtggactggagagtaaggaattggcccagggatggggacatggtccaagctggaccactgatattcagactggcacctttgctgggaccaatggcaatgaggtagtgaaaacatgagcctgcagctgctgctgggacgaaagcagagcccacagatggagagagacaaaatcctgatcatgttaggtgacttctctgcatcctgctgaggtttttgttgttttaattcatacaagctagtaaattcccttttcagcttcattcagtttgagtggcggtttggtactacaaccccaaatgtcctgagtagtgtaatcacaaccagtcattgtaaaggcaaaagcttacaatattagtatttcattaagtcctatatgcacttcagggtgtcactgtaaagggactactttacactaggaatttttatccaaatgaaaatggggattatttacagggttatcaaaaaaaaaaccccacaaaaaaccatagctccttcacacttggtggccagaaagaagtaaatacaagaccctagaaaagtggtactctcattttgatgtgtgtgacactctgaggagtttacagaaaaggcagattttgaggctaccccagaaatcctgcagcaggcccaggaatttgcatttctcatgagtacttcagaggtgctgactgcccactgatgctgatggtccactttaagaaacactacctgggagggtccagctcctcctagatgccgtaggtcaatctagagcgcaaaaatccagctgagaggtaaatcccagactgtgacaaaatggggaaatttccataatgatttcaaactataagatcttcaaggcctactctgagtttaagcacaaattctgaagcaaatgttggcaaatttggaagtgtttcagctctaaaaatggaaggatataagcattatatccagttctctcaatggctgttttataccaaaaaggaagtgatatagaataaaaacaataatttaaaaattgatgtcaagcttatggctttatcagttttataacaataaactatagtaactttgtagtaggtcatagcatgtaattaacaaagacgacctttgagaattcatttcagttttttaacagagcaaccataatgagtacaattataataattggtaagaagcttttacagcattctgtaatacacaatagacaacatggcaaaatagaatagactgtcttctaaaggcaccacgtgagtttcacaaaggaaatcttatgttgactgtgatgtgtaagggggtgatacaaaagtctcttgatgccacatcagacaccacaaaaataagaaaaccatttcctgatgtgcatccatgtttgccttcgttaaaagtcagtggttaaataatcatcaatgacatgactgaatcacagaaaaactatctagccctcctcaataggagttccccaagagaattaagcctaaatactataaagcatccactctatgtaatggattgacactcctttgcatgtaaaatggccttacctctgtaccctccttggaagaactgagaaggcagtctctcaaatcatcttctgtagagcttagatgcttaatgaaacccagtttagaaagactaactgacattccttaagctgaaaatacatgttctgggaaaaataactgtgtaacttttaattccaagcaaggtggtctagcaatagtggttcttgagtagtttctggttctacttgtgaggctttaaattgttcagagtcatactttgaacatcaacacacattttatgccccaagattaatgacatcagtggaactctcaactgtagttcttcaaaaccacacaatagaatttaatatacagcatgaatgtcttggactccttccacaaccattaattgttaaactgccaagctcatctcattatgcagagatcctattcaatccaaggaaaatacagtagtatgacttcagctgaattgcaaaacaaattctgatttgttctgtggttggagctttgtaaaatgtttacacgtttataatgggtttctatgtagagactgatagtatctgattttaatttttgtgtcagatcctgctaatcgaccattccagtatccactctcccttcatttctgactgatagaatctggatttttaagtagacacattagtagaataaaagactacattttctagcttcccttgcagctagatacaggcaatgaaagcagaagtaagtagtaatgttgtatggaagtagaaaatatttcactggaaggggctcatttgtacccttctgctccccctgctctcccttttttgcctgccataaagtgtgatcagtggaaatccaataaatattttgaaccataaagcaaccttaactgtggaggccatgcattagaatgatggagcagaaagataaaaacatccttcactctaccatatcactgacatacatccctaggctgtccacctttacactcctttaacatgagagcaagacacttctattatgcttaatcctctgttatttagcgttttcttaaactgaattaatataaggcacatacagtttattattcagtaaaggccaggtgaattaataaactaattgggactaaaaatttgaacttttgtaatacctaaaacttaaataatatatttaagacaaataaaaagaattagtactttatctaaatggtaacaaaaatacaggaacaaaatattttactggtcaaaaatatatacaacttaaagaggaatttagatcaataataagtcagtacaatgtgtggtgtaaacaataattagtgaaacgtgtattatggtaggtaactatcacataacatatacttatctaaggtaacaaagtgagcccaaaaggtatgggttgaagtttgacatacagacatactgtgtgtctttcttatttatttatttttttcttatttgtttttcttattttcttttgtgtgactcattcattctatgtctatttatattgaataatcaacttctgggctgaatggaagactttggtcttttagctttcatgtacagcagacagacatcttagaaaaatccccaggacaacagaaaattattaacatgcctttgatgtccagtgaatcctttcgagtcagatttttgctgtgtactcttgaaaaggcattaaaatattttaagtaggcttagcaaaaggatcgaaaacattagattgtatttaaaataaaatctatttcttagattgcttttgattatccaggcagaaattttgtttcattgttgctctataatgataagaatttgtgtttattgtgattatttggtcagtaatattttgttttgggaaatattcatgttaaatatcctactaggatcttagagccatccaagctcctgtctactccagtggtaggcagacctttgggaaaacagttaagactcatttcttctgtataatctcagtattattcatttaataccttcacatccttgttctgcattcatatgcaaatatctgtggttgtgtttatgtaaattattggcaaacagtattcactctaactacataaggcagtgtgtaggtatcaaatttaattagagtgatgtacccatgatctcttcagtcagctactgcatactcttccttatgttagccacaagtggggaaagatattagatatttagggagattatttttctagaaaacaatttttttctatcattaacttctctattacaaatatagagatggtccctcatttacaatggttcaacttacgattttttttgactaacagtggtgtgaaatcaacatgcatttggtagaaatcatactgcaagtacctgtacaaccattctgtttttcacttttgctatagtaatcaacaaattacatgagatagtcaacattttattataaaataggctttgtgataaatgactttgcccaactgtaggctaacgtaagtgttctgagcatgtttaaggtaggctaggctaagctatgatgttcaacaggttatgtgtattaaatgcattttcaacttaacaatattttctacttatgatgggcctatcaggatgtgaactcatcataagtcaaggagcatctgcatggctattgagatggcaaaataaagacacttacccctgtgacatccataaccttgatggctgcaagctggcccgttttgacatgacgaccctgtgaagaaaaaataataacaaaagatttagttctgatgatgaatagtagcattcaattccaacaataaagaaaaattgcttggatcagtgctgtactatgtcaatggggggagagagaaagacagacacacacagaaacaccatgtctacttagtgtttattttgtaaaacgtccccagtcactttgtttattttcacagtgggtgtcaagtcaaataaaaaatgcaatgttgaacaatttggttctaactcctctccaaggcatttgacaagagcttatatgagaggaggatttatgtcgaaggggagctaggcctgcgtggaagaatacacaagtatctctctgttagaaaacactcggtagatgaagaaactttggtttctttcattcttaaaatatcctgtgatggttttaactggatatgattctgctataattcacctgagattgttcatttatctttatcttaaaagggagcctaaactaaaacagatagcaatcaatccaaatttgtgatcaaggagacagtgttgaacattaggaactgcttccccaaggtgggctcttttggtctttagaaccacagtgaagcagcaaccacgtggcaaaatcagaaacgagtagggagcgccaagggggcactctcagaagagaattattttctctttgtttgctccttgagaaaacacaatgtctacatgtgactctcagacaacagcaaagatggtcatactcactacttttacatgaattttatatatagcttccaaaatacattttacttattgctgctatcaggcaataaaatatagcttctaagatcagctgggttcaaaacctagctgcatgaccttaggcaagcccctcaaccttccaagcctcagtttcctcatctcaaaaactgaaataataataatacctaatgcatagaattgtagtgagaacgatatgagatcatgtatacaaagtacttgacagtgacatatgcagattagctgtcagcagatgctggccgtaattatgtatggtcctgtcttctggtgaattttaaatgttgtcttccctactgaactgtatgtttcataaaggcaaggaccatgtctcatcgatgtatttccagtacctggaatagtaagggcctcccccatagatgctgtggcatgtttatgaattaacaacagataaggaggcatgtataattgtggtgtggaaaaagtgattggcctagtgtgattcagattcagtagttgaagttggtgaaaatgtgctagtttagttggatcaaattttttaaaagttgtggtagaaaacattagtgggtcaattttgtaattgagaccacctatatctttgtgttcttaaatcctttccctttttctactacttttctcccttactaacctaattttccccactcctctggccctttaacttctgcccactctgcctgtcctctttcttctcacatatctcagctttaaaaatctatttactctgattctgatggtgcttccttccgcttttgacccccattctgctgccctttttttcctcctcactggggaaagagcacaaagaaggggacagtaggtcagtaatccaatatggtcacagacacagcccctcacacttatttccactttcctgaaatcgagggagaggatggcgtgttaccttgtaaagagccctggaccagaatcccagaggcccagttcttgtccaggctctgcccatgaccaccggctgtgtctgggccctcatttccccatctacaaaacgtggggagactgggctcagtggttagtagagagggcagtgagtgggtatcagcactaccaactctttccatcccaagcagcatttagaaatttagtttccacaagattgatagggagagaagtgccactgctacagaaccaggaacactaactttcttgcagagcagcaacgctacctttcctgcaaaccatgagtcaatcttgcacaaggaagaagtagcaacagcgtcctcttttgagtctgtgatgccgtaatgatgacccttgcaaaggaatcaacagctttgtaaccaacagtggactttaaagtaatggctataaatcatgtcttaaataatggctgttcatctgctaaaacactgaaagagggtaggggaaacgtaggcaaatacagagggtctgtctgatattatatagctgatttgccttgaaattattttaatggtacctgtaacaggatacagacaaaccactgggcacggcttgcagggccctccaagagctgaccccctttctgccataccaccttggtaggctcccacttgctcttactctgtggaccttgagaacaaactgtttgcgcttctgtaaatgtactttattgtttcttgcctctcagatggtatgttttcttggtctgggatgccctttgccttcttgactcctcagacaacttactctctctttccagattcaattacagtactctgtcctctgatacctcacttgtcgattcctcgtcacctctgtctatcaatgaacatgtccctgtgtgtattattccaaggacctcaaaggattaatatccctctctccctctctggtcttccttcctctctcccttccttcccctgtggctccatttgcagcccaaccttttccccaaataaaaccttaagtgaactcccttggttcaagcagggacttgactgcccaactctagtctgctctgcctcccgactcccctcattcctgagggagtccctgaggcatgtctgccagcatgcactttgagagactttgcagtagatttttaagtccttaagaagcaggaaatcctctttgagtgaataatttgttacaaggacacctcaacacctagttcttcccatcagcagcctagggctgagccagcccatggtactggctcaaggccagagatgaggcgggataaaagtgacgtgtgttacatttcgaacacaggcagtgggcagttcttgttggaataaataagatatcagctcttttaaaaaacctagtatacttggcttttgttgttgctactgttttttgttttgttgttgttgttgttttgtttttttttttgtttttttaagtagccactatgaaaatgatggaaggtaacactggaaaagaaaacaacactttaaattttaaatttcatttcccggctgaaacagcagttctcagtgggtctgacagctaactgaaaaatacaccttgggatggcagtttgggcttacatgagatcctggaggtggaacaattagcagcctcagatcactcccaggcaaaggtatccccacgcgctagagcaggaaggatgctgagctgtcacattttgctgatcaggaaagggccatgaaggaacttgcccagcatgagctgccttttctatccccagagaacatcaggccaagttatgatccagattaaggcagacttggagggaatggcagggagtcagccgacctaaagctcactaggaacctgaggcacagtcattgtaagacagtttttaaagaggtaactttataaaatcagaaatgaattgagtaggaaggggcccctaagagcctaacccaatcctctccttttagagatcaggccaaaacttcacagctaaacttaggacactttctcctccatcccacttctaccatccagctcctaaatcacaaatttctatcgccaaacttttaaaataatttttaaaacaaacttttaatattttacttaactggaactaaatatcgaaccagtcatctttgcttcacataggatttttaataatttattttttaaatttgggggcagtgcaacgaaggggatgttattgcaatagaattttgaagggaaaatgtaacagtaccccaattctaatttatttttccttataagagaaatttaaaatacaaatatagacaccatctaaatttagatctaaaatacatgtttcaagctggtgcagtgttgcacgtctgtacacccagctacttgggaggctgaggcagaaggatggcttgactccaggagttcgaggctggcctgagaaacacagcaagatcccatctctaaaatggacaaatgtatgaatgaaaaaaaaaaaccacatgtgcaaccaagaactaaaaattaaattctgaaaagaaaaaacttctaaaaggagataaaagagtttaaaaaaattctccatgaaaattagagaaaatgtcctatcagattgcagttgctgagtcattttttaataaaaggatgaactgaattatttttttcctacagaaataaccaataatggcaaaagctagtgaacatgctaaatctagaaaagtaaaactgatattctgataggaccccaagcctaatgtcagataatgtcctaaagcataaaaagcctatccaccagaaaggaacaagaaaggcatcaaaacaagggaggcagagccttggggtcacggctcagcctggtcctcagacacacttaagaacctactctgctcccctcttcccttcttctccctcacttttgaggcaacaaactatgctgatccttgttctatgtaaaataattcaacatcgaggtgaaatccaaatcactcaagtacgattaatacaataccctactccttcaactcctccctaaaatgaatgcaagagaaaacaacagttttgttttaacagccacataagcttcacttttgttattgttgttattttctaaggaagagcaagagggtttttgagctgctagcctaaggctagcctggaagacagaatactttcatttctaggtcacccacatacatttatttctggcaaagcactcaagcaaaccatctttgttgaaaattcagacattccccccactgtcttcatcctcctgccaaaggaagctcacacacaggtagagagtggctcattctccttcctatctaccttagatttaatctccactttattgaggaagtcgtcttcaatttcctaattgcaaatgagtactccacctttgtgtttccacagaatactatcccaaccccactgatcataaccagcactgtgatttttttttcaaaacacgcatcaccagaaccatgaaaataaatcaaatcaaaatggaaaaaaaaagcagaatgtagaatatgtagtaatggcagctgttgttttatggctcacctgttcttattctatctgtctgtctgtctgtctatctatctatctatcatctgtgtatcaatcatagatgctgcagtgtgccaccaagattctcgagtacagactgaagtacctgacaactctgtcaggtccctctctgggaatggcccttagccaaagagccacctcacccaaggtcatgctccttcctggagaaaggtgaaggatgatggccacttggattaggatggaaagggtggagaatgtgggaatggacaggaggccaaatgaagaggacttgggaatagattggatatgtatttcccttgtgccttcatagtgcttggcacagcaggcactcagcaaatatttgctgaaaaacagactgaatgaaggcatgaaatttgagggttgcgtttgggttcttggtaccatccacatatctacatctgtttcccttacccccacatttccccagccacagagtgtatgggaccagatagggtggggttgtaagcaggaattataattattttgctcataaataaaaacctggaagatgattttaagtggatgaagttcttttaaactctacagagagaccagtttactttccctttccatagatcacagagaaaccagaaattggttttagctttacttctgagctgtcatgatgatggcaaacatgaactctggttttccactcccatttgagactaaaggttagttaatatctatctggacatctttaggaatgctacctttccttgatacaacatgtcttgaggcaaagaggtagacaagacaactttatgaaaagactccaaagatccttatgatcaagtaacatgaatgttcacagagcatacttggcatgatgtccattcctaagtcttccccaggttaaatggagcctttgtgtttccttggcctacatgtgccattcgttggtggcttaaaaaccctgctctccatatgtgcagaactgtaattcagactttatggctcccagacttgtggcagaggtaaagcaaggtaccgactcaggatggtgcccaagcaattactctccatctcaacaccactcactgtgaattcctttgcttggcacctctgagtgacagaaaatggattgctttcaagactgttcaggggtgggccaactgaaagctgagacttgctcacagacatgaagtggggaagaagagactgggtttcatttttctttgttagaaactaggattcttcagtcttcctggctgccagcttggctcagtttataaatcaaaatggatgcttaaagggaaaaaaatcaaatagtcacaatttttagcagacaatagttaatgtatgcagattccgtggcagggagcctaatgcctgtacccaggaaagacacgcacagctgaagtgacagcagtgacgaggcagacaagatgaggggtgacgagaactcaaaagcagacgagccagcctctgggccagggccttgcgccaagaacacacttcccagtaacctcctctcaacccaaaaaatgagcacaaaaccaaagctctcactggctctcatctaatttataccacagaattaccacaatcatctgtggctttttaaaaattttttatttgtttatttattcatttatttatttatttattttgagacggagtctcactctgttgcccaggctggagtacagtggcgctgtctcggcccactgcaatctccacctcctgggttcaagtgattctcctgcctcagcctcccaagtagctgggattactggttcccactaccatgcccagctaatttttgtagttttagtagagccagggtttcgccatgttggccaggctggtcttgaactcttgacctcaagtgatctgcccaccttggcttcccaaagtgctgggattacaggcatgagtcaccacgcccaatctcatctgtggctttcatacattcatttctgggaggactaacccccctaggtgtgggggctcaaaagatggcgacaaagtatgtacatgcagccaactcttcagcctctccaaatatcccactcctccccacacagcacaatagccttccctatcccctgaaccaagaatggcacctggggctataaacatcattcaaaaccctggtacctgaacactagtccaaggtaaagtttacatacaactccagtaaaaggtgaaaaataaggacccagtggtgattttttcagaaaacaagaggtattcaacttaagcaggattcttatttttggtgttaaaatgcccattaatgaaatgtttttaacttttaaaagttaacaaccatatgtttttgttgttgttgttgtttttgttttgttttgttttggtggggggggggtttatagagtgagattttagtattccatgaaatctgagaatccaggaaaaagtatttttacatacatgaacttagtagaagggtcaataaccctctgaagacacaaaaaaggttcttgatgcaacctggaaaaagttaaatgtgagggtgtatagcccttaataacttaaaatagcctgtgtgaattgtattggaacccacttctctctcctctgggtgccctaagtccctaatgcccttaaaacgcagtcctccaggcacatggctgctacatactagaacagaaagcccctcaaaggcaggaactccaccttaaacctgtttaatcctctaacattgcctgggacagcgtcttgtaaagggtaggtgccaaatcacactggaaaacatcaagtttctaggcctagtgaaccttgtaaattgccacaaatcacaatgaacagagattcctgtgatccatcaggggctacacctgggagaatcttgatagaatttggggaaatgtctacttccgcgtgtcagaagcttaagaaaaaagaggaccataagaatggcttacggtgtcctaactggaggggaaagctatgtgatctgatgtgagtgttttgctcaacaaggttctgtttttgttttcttttccaagtgttaactaagaaaactaggtcactgaaataggccctggaggctcactagagacattagcattctgcatgtcataatcaacagcttaccagaggaaagggtcagggagagaaagatgcatcaagagaaaagcaaggtccagacgctgccctgccaacatcctttcacctctgcctcctcttttcccgagctggtactaactagaggtaggacgatgcaactgttcttggagaaacagggttcatttttaaagatttcaaatcaatagctccctctctaaggactactttatgaggcaactctgtctttcccctcaggacctctggcagactctttgctcactccatcccacctcctagctgcagataaagaagatatattacatcctctcccctggccctgcacagggttgccaaatgcagcccgaagctggcccctattgtctgagatttacaaccaggtgattgggagtgggcagggttggctttggaccacagacacgataggctgggggttgggggaaatagatgataataataataaaaaggcaatgctgcatttcattttgcctaatgtatggcttcaataggaagccagtccacccacagtcctgtctcattcacttaatagacttctgcagcagcagcaggagcagtctcctgttcagaaagaaaaaggaccacactggtgtcatgagaaaaaacaaaggcaaaggaccacagtgttcccagctatcattcttggggtggcagtaacacaaatcgggacccatttggctctttatttgggctgttgatgaataaaccctctcccacggtgtcctcaaacctccagcagttttaattaaaacaaaagaaatgtcagcagggaaaagactggaatataattagggcccaccaaatctaaagtaatatgggggaaaaagactagtaatgaaagggaagctttcaggttcttactgaatccccgctctgttactgacacaaaaatcaatttcaataggctttagttgtatctgaacgggaacacagtgacagatgaaatttagtgagcaacttactggagtcataatgattcccacggaaaaaaaaaaaaagactacaatgagcactcccagccaaatgtctcctctgtaagaatgtgtatgtttattatacatacacataacatgtatgttggtaaaattatatctaaaacttatatacctaaaacatatataggctgagtgtggtggctcatgcctataattctagtgctttgagaggccaaggcaggaggatcacttgcagccaggaactcgagaccagcctgagcaatatagtgagaccccgtctctataaaaaatctaaaaattagccagacctagtggcatgcacctgtagtcccagctactctgccgaggtgggaggatcacttgagcccaggagtttgaggctgcagtatgctcttgtatgtacttgcactccttttaaacttaaactagatctacctagaagtaaacctaccatccccattgacgtcatctgactggagacagcaacattctttaacagtcccattacaaaaggagaacctggtccatattggttaatagcagaagacccagatctccgcaaaggctgaaaatatctctccccctccaacagatgtcttctgtgtcagcacagactgcatttgcgattgtgatttctgagcaaagacctgcatattgttctctgggaaggagggtgagaggacaaaaaggacattagaaaactgaaagttgttttataaatgcaggatggctcttacatattcataatctttcaaaaaaattcataaaattcaaaaaaattgaattttatgattgtgccactgcactccaacctgggggacagagtgagatcctatctctaaaaaaaaaaaaattaaaaatgataatattgtatatatacaaatatactacattgtaaatatatacatatggaggagagagaatttaaaaactagtttttttttaatcccaaaaaatgtaaattctccctctcaaaccctttaaaacagtggttttcagcggggcaactttgcttcccaggggacatctgatgttgtctggagacatcttttgattgttatgactgcagctactgacaattagtgggtagaggtcagggatgctactaaatcttcataatgcacaggacaccacccttccccaacaagcaataattgggtctaaaatgtcaatggagtcaaggttgagaaaccatgttttaaaagaatttgacatttcataggtgctcaatgaatgctggagtctatgaaatgtcagattctgcaataggcactaatactacaaagatcaaatgataaggtcttgacctcagggatctcccatggcttaagggaggcacagcagacgacgaattgttctttccttgcttagtagaatcttacatgtaaaatcttttcttaaatcccaaaaatgtatgttctttaagaacacaggcaatactatacccagtgacttctgagaccacttttcaactggcttttgagtggccaattctaagactttcccatttaagcagcatattctaaatttttaaaaaacctaatgaagtattattaggactaaatggaatttggtttattataactggacacaattctggctaattatgttaattttagaaagaatatcctattttcattttaaaacaatatttacatcttaataactcttcatactacgtgttctttccttcttaaaggtttacttatagttttaagttatcaggtactcaattcagaaatatattattttgtttgattaaaatataagtcatgtgaagttttaagctaaaaatgtaacagtcaatgacaagagaataaaggtgtttgcctttatccaacataagttcttcaaatgcagggatataggaatcttgcaattgctgtaagcgatctgtttccaagaaataaggaaagcaaaattcaattttttagaaaaaataaatgagcagcattattctatatcactgacaccattcaccaccttttagatacttaaggattaaagaactcaagatggtcaaagaataacatccaaatatagactctccacagtgtatgaaagaaataattatggcctattaattgttccacctgcaatagcagaagacccagatctccgcaaaggctgaaaatatctctccccctccaacagatgtcttctgtgtcagcacagactgcatttgcgattgtgatttctgagcaaagacctgcatattacaaaaaggacattagaaaactgaaagttgttttataaatgcaggatggctcttacatattcataatccttcaaagtgatggccatcacagactacagcaatttgtcagcaaacacatccatccctgggaagctagttgctgggagtaagtagtcaagtgcctctcagaaacctgtactctcccatcaggacaataatgctgagaacacttttgtctgaaatcttgggggaggggcgggggtgaaatatgatgacacactgagaaagaacaagggctgttttaagtaaatatgatctgccccaagctctgggtaggcctgaatgggagggtagctgactagttagtaaatgcattgatttatagttaaatttagctgcgatccaactgtgacctatcaggtagcttcgtctcaaggagggtgagttttccctgactccagtgaaattcttctttccaccacattttcatgcctccagtttaggtcgactcatcagggatcgtgagacgggtaagcacagcatcttgctgactcttggaaatcttctcttctcgagcaggtatttcacatagtctaggagagaattgactatctgtagctagagctctgcaggccctatagaggacgtggaggttacgaggaaaggctttgaaagaggtatgaggttcccttggactaattagtgggtctagagttagaacctctaactgtgtagaacagatacaaaacaattagctcactaggttgcagtaaggattaaattacatgtgtagatacacttggtagagtggctgggtaaatggtgttatcacagtgcttttagtgtgattgaggttccatttctgttctcttctcctactattcccccccagtccccgactcgcccacattgcaggtctagtttccttctccctttcctccaatgtaccatggggactttacatgtctcttccttctgccacacttgaatgctcgctgccttcaggtcttgacttgaatgggtcaaagagtctcaaatgactcttctccaatagtctttttctggctgctatatctaaaacttcaactccactttaactcttattatcctccttccctgctttacagatcatctaacaaactatacagtttatttatttatcatgagtatcgggcatttcctgctctaggagggaaatgtcttgagggcagcggcttctctttgtcttgttcactattctgtcttcagtagcagatcagtgcccgcatggtgggtactcaatcaatatgtgctgtatgaatgaattcctaacctctttgtggaaacacttttccaagtccttctgtttctttttttttcttttctttttttttttggagatagagttctgctcttgttgcccagtttggagtgcaacggcacgatcttggctcaccgcaacctccacctcccagtttcaagagattctcctgcctcagcctcccgagtagctgggattacaggtgcgcaccaccacacccagttaattttgtacttttagtagagacagggtttcttcatgttagtcaggctggtctcaaactcccgacctcaggtgatccaactgcctcagcctcccaaagtgctgggattacagcacttctgttctctttttaaaaattcatagcacttcttacttgaaggcataacaactctgatagaacaagtactgttatcagactttaaaactgaggctcaaaaaacccaagatttttccaggttgtattttcctttcatattggccttgcatataagtcaagcaaacaataagatattgtctctctcttttaaaattctatttaaattctctctaaagaataaagaacagaagtgtaaattaaaatgcctgataatcagaatatattttccacctaggaagatttatttctgtaaatatatatgctttatttaaatattagcaatataaagtatagaagcagaggtaactgcatctctaagatatatttctgctagcagcagccaacagatctaccttacaggtagcagttaagaatgaggctgtgctattcacaatagcaaagacttggaaccaacccaaatgtccatcgatgatagactggattaagaaaatgtggcacatatacaccatggaatactatgcagccataaaaaaggatgagttcaagtcctttgtagggacatggatgaagctggaaaccatcattctcagcaagctattgcaaggacaaaaaaccaaacaccacatgttctcactcaggtgggaattgaacaatgagaacacttggacacaggaaggggaacatcacacaccggggcctgttgtggggtggggggaagggggagggatagcattaggagatacacctaatgtaaatgacaagttaatgggtgcagcacaccaacatggcacatgtatatatatgtaacaaacctgtatgttgtgcatttgtaccctagaacttaaattaaaaaaaaaaaaaagaatgaggctgtgctttttgaaccaaagagaacatttgatcctctttccctgacataaatatggaaagacggaaaatttgcctaaactgttaagacctcagtcagctaaggacacctgcacaaaacacgaaaattgccttccttcctcctcttcctcattttcaattgtgaaataggtgtaggcatatggtcaaagactcataagcaggatctcttctaacagcacctgatctgaaaatatcaagtctaatttcaacctagttgccagtatctgatttcaatcacattggttgggtcttaggtacttgcctaggatccaaaagatcagtatcaatctgcatttttttttttttatcatttaactcagcagtcttgtgtttgcaacattaatggtttatttcactggtggcttctgtctgcatgagggacattaagaaaataaaattggcgctcatataagcaaaataactgaattgctggatttagtcattaaaatatacctcatgatatcccaggaactcttaaccagaaaatctgtcttagatttaataaaccactgatggtaatttaatgccaataataacacaatatttattaaccactgatgagcattcaacggttcatgggcttgagtactgaaaaatatgtagcaattatacatatgatgctttaaaagattgaattatacttcttaaacatgttatttctgtttttacatttttaaacataaaaaaatctttttgagaagaatacattttaggaaacaaattcagaacccataaaaaaatctttggaaataataaatgcagtggagctaaaggagtaaaaatacataagttctatttagaatttgatcagttttcaatttttcaataaggctctaggcaaatctttttagctctcatggttttcatgaagaagagaaatagaaatacttgttatgcctgttttcccttccagaactgaaatgcaaacaggagtgtccggataaggtgagttctttcgaactccactttcagtggagttgtctaaccttgacaactcctgcccagggattcacaacatatcataaatacatacactattacactattaaggaaaagggcagccaataaaaatttcctgaaagggcatcatttctgtaagttgaaatggatttcagtgccctttgatatgtggtcaagtttttacaaagaaaggtcttatgaagaaaatctaatttcacataaaatgaacataatatttatagtaaattaaaaaaaaaaaacaccttcttatccaactcacaagccacattgttacacaactccaaaaagcacccttcccattgttttctataaaagtggcatcttctggggttgaacctgttggtagccctgttaattaaaagttaaattcatagactccttactgagcagctattatatataaagcactgtcttcatttctgagggacctgagtcttaagtcgattttattattaaattatttacatttctcacacaacaaatttagcttcatttttaatggattttactcctagaggaaggtttataaaaatatgtatttttatttttccctgttggttccattttcagaggctttctccaaatcaattatggccaagatcaactcatggcatcttatttgggggaagacaccactaaaagaaaatcttcaatatatgtggttttaggaaacataataattaaagaaaaatcgtgagaaaagaaatccaccgttattaactcattgagaaagaaccatcgatgttagatccagagtattcttccttaatttactttgtaaggtccttcgagaaaaagctcaagtgcagaaaacaattgaagaggactgcaattttgttttttttagagacagaaatagttttttttttttttttttaagacagagtctcgctctgtcgcccgccggggtgggaatgcaggcgtgcgatctcggctcactgcaagctccgcctcccgggttcacaccactctcctgcctcagcctcccgagtagctgggactacaggcgcccgccaccacgcccggctaattttttgtattttttagtagagacggggtttcaccatgttagccaggatggtctcgatcttctgacctcgtgatccacccacctcggcctcccaaagtgctgggattacaggcgtgagccactgcgcccggccagaaataaaattttaactttgtgcttacttagtgctatactattctcaagagagaactcgtttactcaaaaaaatcaggattctaatacttctcaaacatactcacttattctgggggaaaaaaccacttttctcaaagagcttaataaatgatagcaaaaaagggatttgctgcattccaatttattttgtactggctaatacattagccagtacatacttttcatctggtcacatactatttctaccatggctttaagtaaatatactattaagaaaactatcatgtttttgaactcgaaatttaatccatcggcctctatgttacaaaggtgagatagaaatgaacttcattattgtatttcattaattgacacacccatatttgatatactttattagaaaaatcaactcaatagtgataggatgacaacttactgcttctctttaaatattatatatttattattaaaattatttaaatttaataattttaataaggagtatatcatagggcttgtctagatttcaacaaaaggcttgaaattactacaagattatgaaaaaggagcaatgaagctactgaaaaagatttgtataaacttcataactgctattttgcatttaactataccaataatgattcatgagcaatttcttcctggatgccaatactcttagaaaccctcaagaaatacagtattaaagcaaatgattggaaaaaagaagactgaataaaggatgcagtagttcagacgtgttgtacttctatctccattgtgtataaaggtgccagctgtgtagggacttgggctctataaaacaaagactttgaagtttcattcttcaacactcaacttaggtaaggatgtaattaaaacaaattccaccacctaaatcaaagttagagaatttagagaatgctttgagcatgatctgaaatgatttgataaacagcacaattgggtaaaactgtcaagacattcatagcttcaggaatgggctgataaaaaaacatgtaataacatacaaatacatgaatgtcaccagaacagctgatcaccttatcatactaaaaataaaagaaacaacatttaaaccataaatttttaaattttattataaagtagatttgtgaaggtgattaaagggccagagttacccaggaaggttgggacatctttttaagatactttaacaataaaaaaaaaaaaaaatagatcctcaagattttggtataatcaaggtgttaccattatcaaatggaagaggggaagaatagattgattttaaaaatctgtgtactaatttttacagtttacatatttcttttctatagatcatctcatttgcttctggtaactttcctttgtccaagaatttactcactactgaatgcctcaaatgcaggtctgaataaaatgctatttcttgccctcatggaacttataatcatgactttcttttgttatacattttcggtattatgactattttgatttaagtaaatcaacatcaaatcctattggaaataagagagagagaaagagagagaaacagacagacagacagacagacttgggggaggggagcagatgaagaacggaagtagatgcttgtgtagggcagccttgaaaacacacaggaaggaaagcaaagaaggcctggagggtgcagcttcagatagagggaaaggagctatgtgtgagtgagggaggaagacgagtgtgctgcaggagagggtgagaaaggttggattgttctgccttattccctgagcctaatttgcttagatagaatcccaaagccattctcaagtcaaagaaaaagatacacctttgagacaacagtggaaactaagatggctccacaaccatgagtaataaattagatcccactgacacttgggtagagaaccagataaaaaaaaaaaaatgcctttctattcatacttcaaaacaaaacagattctaatcacctcagcaaaaataggagggctggaaataatagatagtctgtaagatttgtagctggtaaatgaaaaattattattaatagctaatatctactatgtcaggttctgttataagcattttacacacattaactcatcacagcccattatgctgttaccctcattttacagataaggaaacgcacaaagaagttagatgacttgttgaaagtatctattatttaacataggcagcatctcatttgacttctgcattttctttattgcttccttttagcaaacaaaaaaaatatttctaagagctttcattagattgaaaatattttcagagttcacttacaatcttagtctttctagcactagtttttccctcaagatcttgagttttcagctattatttctcaaaatggagttttcagaaggcaggcggtgacttcagtctaggacatacaaggtttgcaggaggctggccgcttgagaagttgatattatgatgcgcagatggccaaaagttccacagagcaaccaactcagactgggctgaacagaaatggtagcaaaagtaggactttaattcagtcctaaaagatcagaagaataagactggggggaagacaaggaaggacatttcaagcaacaagtaaaggcactggccaatgtatgaggaagggcttaagtctgtgtatggctatgacatcacatgtgtgtagaaaatagcaggatatgcaattggagaagacaaagtcccaatgaagaacagcttcctgtgtcacgtaaggagtacgatgttaaagagtttacacttgggagttacaagatcagactggattccagaaaggtcaccctgtcaccatcttccccactccttgcccaccttcctacccgctaccactcagatccaggattgcagttcatctgtcctctaccaagatttggagatgattaatccagtcaggatctgaaacaaaggctggcagtgaaaagagaatagatccaaagaataaataagtagaatcaacaggacatgtagatggtgttttggagaattgaaagagaaacagaagtcctccaggaagataacatctctggcttgtacaatctaggtgggtaagagtgccattctttgagacagaagactcgggaaaacatgaagaaggcaggaagtgacttcagtcaaggacataacaaggttttcgggggccgggtagacatccagacagatgtgtccattagtccagtggagaagactgggcttcaggaggtcaagtcagtctacagagacagaaggacttgcaatgaaccccaagaaaaaacaaccagcgggtgggaaaaaagaaagcagcaatatgactgcaaatcaaggaaagagaaagtttcaggaaggaggatgtgatgagtttcaaaaaggagggtatggtcagagccagtgctacagaagaccaagtgaaataaagactaaaaagagctcattcaatctggcaattatgaagcccctgggaccttacacagcaatgcagggacagacatcagtttgtatagagtgaaggaaaaaatgggaggtgactatgtggaggcaaagagggtagaaaaaagttgcttggtctgaaaagagatgaaactagtcctgaggtctcgctgaagatgactgcaggctgggaggaaaggggcaattctgggcaagggaggagacaacagaaacagcaggaggagtcctctcacacagagggaaaagctttacattgagttaggatgaaagaaggtaagaatgtgggaagaagatgagtttgagaagaaaggcagagggagacctgtgggatatttacccaataagggatacctgtccaatggctccagtttttctaaaaggcatagaagaaggtcacctgtggagaacaatgaaggcaggggcagcggaagggaggagaggagagtggtggagattgggagcaactattccagggaaaacaggagaaggaactgagcaggtacatacacagttgattattaagcagtgctgagttgagctgtgcagcccaaatgcagaaaaataaacagctagactgaccttagggaaggggtctgcaaggtggatattatggaagaacaaaggataaaggagatagtacatgttggctaaaaatgattaaactaagaaatcatgaggcccaaggctggagagacaagttattaaagtttcatggggactgagagactgacaaaagacccgagggcttagtcaacatcaaagaacaggtgtgtagggtgtgagggagtacaggctggaagcatcaaaggctgtggtctaagattgggatgctgtacatttaagattttaaaagcaaaacagacctgggtcataaaaagtccaggttgtgaataataagagtggggtgtcattccaggtaatagcaatataactatagtatcaatattataccattttacaagtgagacaaggactagatgacttattcaacatcacagctggttaatggcaaggctaaagtttcaatccaagtctttgctgccaagtcttattgaccttgtcatacaaaatcattttacttggtacctttttctttcagcctttgaataagaaataataaaatggtgattttgctttcagactaggacgacgttataaatgaaagaaagctatcaatctgacttaaaatgcaagtgaaagtaacggttttattttcagaactctggttattacccatagtgtaggagcttatgaaattctgttaaagtgtatctttgcatactgttttcttattatagaaacattaaaagtaactagctattgaacatggcaacaaaaatagttaagaaccactttatctcataaaacataaatttcagcctccagtggcatgtctgctattatttcataattctgggtcccactccctattaagtccaaggctgtgtcaggatgatttaggaagataaagcaatgttacaccacatattttcaacccaggtacctttaggcatacatccaaatgtgaatatcagatctgtacaaatgtaaatggagttgtcattttctttgattaagaatcactcaggctctccatcaccattactagacaagacagagtggcctgctgccaacttaagggggctggagggatggggcagtggtgtggaaatggcaaattaggggcctcctgcagtgagttactgctcaccagtcctgggcagcccttaggacattatacattaagacacatattcaaatggaatgatggtggtacacatcagcataattcacctcaaataattcattacaaaaagacaaatgaacaaatgtcaaatttgctgcctatgatattagctattactgtcttgtacgatatatattaagtgaggagcctgcaggaaagcatatacagttattccatagctatttatttcatccactcttgaggcaagtagcgtctttccctgtcagttggaaccaatccaacccacccaacccaacctacctagactccctaactgttcctagctatcctggtttcttactgagctagtaactaatagtttgcttttactgtatatcaacttgtcaggctaaggttttacatgattactatttaatccccacattgcccatgtgaagtaggtgctactaccacccccattatactaatgaagagagcaaagcacagtcccaaagtcagccagctggtaaggccaagctcttagcgatgcctgcatgcttctgcctttgttactccgcctttcaaatttcacccaacttctgctctatagcttgatggcacatgttcaggaagaattcccatttacttcagtccatactgattactcccttctcagaagtagctcatccatacctggatggaagctttgctttctggtaatgccagcaccctctaattttcatgggacaggccttggagagactgacccagtcttgtttgcctgggaaaatggtgttgatggatggacagcttctttgtggtagtgagatttgggttaaatagctccagtaccttaaaaattccaagatgtaacctaagccctagtcccccaaaatattcagaaacagggattcctagaaatctaaatcatgccctttaaaaatttcgtgtccaaacctgatagacttaaaaaattagaaatgaagaatattagagacattcatgtccactgatattaaccccttccatcctacttctctaaagccatgcagctagctcagagaaaagtaggaactccaactccttcagctgtgggaggtgggaacaacacaggccctgtggtcagataccttcagttctgtcactcactggctgtgtgaccatgaggaaatcattcagatctctttagatctcagtttccacactaaaatcagagaaatgatacttaaggccgttataagaactaaaatagctaatgtgaaagttttgtaaaccatatagtgctctaaaaatgctacaaacttccattattattctacatttgggatttctgactttcatgacagagatttgtttttatcttgcaatcctctgctgcaacaattatcaattgatggtgtcccagaccactgtcaaaatacagtgtacattattcaaagaccccaaataccaaatggtcacaagcctagtgtgttattatgtctgaaagtgtttgagtgaccaaagaatgactgaagctctcatctaaacagcagaaggaaaaccagaataacccaacaaaaggtatcatgtacacacatcaactaccagacaggttaaaggtgggcaacatcctatgagagatgagactaaattaaagcacatgttggaacctgcctgtggtctgggaagaacagcagatacagacagcagagaacagcaggaacagacaacagagaccgggacacagatatgagaacttcctaaagaaggaagaagggatgagtccattaaaagatgacaatttagaatgtcaagagtcctctggtgtgttctaaaatgaggctggctacttgtgttgttagaggcctgagatgatgtctacatgtttgggtaatgatcttggatgatatgaactgatagctaggcccagaagtaagaaacaggtactgccataatagttatcaaccttcctgccacagtcttgggatgagttcctctgtcctgggcaagttggctggggctgaagcacagagcaagggccattgcaaggtgctccttattaggacatttttcatctaacttagacccacagactatgtgcacttagttggggcctaattatcaagaacctgtattccacacatacactatttgatacttaatataaataatgtacccaattttatttagcaaaactagcaaaacttgtactcaaaatgaatgttgtctctaggcactaataccattgatgtttaaatcattctgaaattacctacatcacatccctttgaatatagaaaaataatatggctcatctttgttaaaaagtatatttaattttttacatttaatatcattctaaacgggtaaggaaggtgaaagattgagttggataaaactgttagaaagtaaatatgataacagaccaaaaagaaattttgtggtttgtgtatttcatcaccaaaagaaagtagctcccaaatttatagggcaattgcaacatttttgaaggaaatacgtgcaattctctaaggtaaatgttcatttgcatagataaaatctggtatgcgtgtgtgtgtgtgtgtgcgtgtgtgtgtgtcatatctctttacttaacagccaaaacaatctcctatgttaccttcagccattgtttcccctcccctataaatacatcttcattgcaagcagtttgtgggtgagaaaatgcctccattttacctatgttcaccagttagttacaacctgttgggcatacagtaggtgctaaataaatgactgacttttaagcctcaaaacttaactatagataagtgttccgaacacaagaagtagaaaactcaagctatatgggcagccgatgaaaattaactgtgcacttatataggcagatgtaattaaaaatgaggggaggagaagagaggaataaacaaaaccaccccaaaaactcatatcgtgtgcacgacattatatctgaaagtgtcataaatttccattttatagcattaggaagctgccttatgttaattcaaggtgggtaacatgcatattaaaatatagctgtgctatctctgcattgttctcccagcttagaaggtaaaatactgaagcaaacatgtggcctaccagtgggaattaaattagagcgatattttacatcattgcatagcattggttctttgacattcacaatgttaactttgatataagaaatcagctaggttagttttatctgtttatctgggagaaacttaatctgggttttgtaagaaaatcatggggtagtggaatggggagagcactcggttcctggtgacaccatctaaatcttgaagaacataaaaataaacagctaggatttcaccatgtaagacaggaaaaatgggcacttcagaaaatttaaatggagtaggggtgtagagaagcatttcatgttttagaatgcatagttttttggggccgaaggaaaccactcttagtcaactttaagaaataactagggccgggcacagtggctcgtgcctgtaattccagccctttgggaggccgaggcgagtggatcacgaggtcaggagttcgagaccatcctggccaacacggtgaaacctcgtctttactaaaggtaccaaaaaaaaaaaaattagccgggcgtggtggcaggtgcctatagtcccagctgcttgggaggttgaggcaggagaatggcgtgaacccaggaggcggaacttgcagtgagccgagatcacaccactgcactccagcctgggcaacaaagcaagactgtctcaaaaaaaaaaaaaagaaataactaaagtatctgggaatattaaaccatgacttcaaagctgtccctcttgcagcctcagtgaggtgcgaaaggtctctgatttcaggcacccctcactctggcttaattctttcactctcacatatggttgtctgataaatccagctaaaagcaaaacctgtgatgaggtctcaacttgctcctctgcctcccaaccctccctttaagcttgtgaccaaattgctgaattcacctcctttctcatagatctgcctgaaaaaaaaaagaaaagaaatcagaagacaggtcccccccccaccccacccccagttatctcaaatgtcacggctaggaagtttaggctgcatggaccatcaagaccctacaataaattgaagtaacaaacatattaccttctcccgaatcctctctgaacagatcaccgtttctctaccctccccaagggaaactctgatcaaacaaatctagccactctttcccttaaagagcaaaactcacaaaattaagttaaaaattcattcttgaaggttggaaaacagcaggaaatgtctttattctacatattaaaacttccagagaaatcaataaaacaaagaatgtaactagctgtccttcaagagtttaaataaaaacacacaactagcaaaattatgaagtgtgtctttcaggatccatttttctggacatgactcagacaaccagccatttaaagccctctttacatttagtgtttttaatatctgctcttaaattcttaattcatcccaaagtgcaaatgattaatattaaatttccttttttcttaagaatgtttattttagcaagaaaatagtaacttccagtacttgtggaacaacagaacaaagaccttccatacctcatttatattgatcttaatgtagcgtgtctattactaaagacattttacagaataaaaccccaaatagtcttaaaaagataatttgattttcttaaggaccattctccaaattcttcggaccccaaagaccacaccacactcttcctctatcaggctgctacaagatgaaggaatgatcaactaatttacagaattttaggctttacctagagcagtggagaatgcagtttttagagttttaatatttgctcacccttccccatataaagcagagtctcaaatataaacccagatttcctgcctgcaactgtaaattcagtttctggatatacatcaccaagataaactgttagatacaagcatcacccagatgttttgtagtattcatattaataatcctataagcctctctttggggcagaaaacaatgatcattactgatccaatttccattactggatgaagactcccaactactaatacagatacatgtgtctatccctccctttacagctaacatataagggctaaatggaaatcctagtagtacagcatttatctatcattttgcaataatctgtgggcagataacacaatagcgactcgttcctttaattcaatttcataatcagaagtgatatgcaaaatataagtacagaaaagctattttcagaaaatatgatctgatttttcacagtttttgaataagcaagataaacgttataatttggagtatggtaatggctttgggaattgtgttctgagaagtaaaataaaaagggatttagcatgtagattaatcatatggcttttccaaagattcaaaattttgagaaagccatttttaacatatctgaaaatcacttagaattttcagtgccatcctagcctcttcctctaattttggttcataaccacatcttattttgctggattgcaatggactttgaggttgcaatatgttttatctgatgctgattcaatttagacaataaaggattgaagttcttgaaagaaacatctggccaacaaaacctgatatgagcagagaaactattaatcattactttaggttatggaaaatcccacattcaaatgaaccaaaaagattcttgaaaatctatccctctactccccatgaggaaacagtagatttttctaaagctccctgggtgacaaatgctgtctggttacaaccatcttagctagagctaagatggtttcagaatcaaactacaaatcattttgaaagtttcctgttttgcaaactccggatataagctaaagcgatttttctattcactacctagacatcacctgctcatcaacagattttaaagcatcttgcagaggcaaatttccaaaaaaggtagcctaagtacttatccactataccacctcttcaaaagcagcagagaataaatacaaagttgtctgattagtcagtaaacaaaatgaattcaagctgaggtgcctgaacacgggcaaaggaatgttttgtgccacaggcccaaaagaacaaagctcattttgttgcacattatcaggtgtcatggttcatatcctggagtgcctttagagaccccaggtgtggctgctgctcagtgtttcagaaacattcttctgtttggaaggacattgaagagccgtaaatgccacaacagtttctctactttctaggccctctatggttttgaaattcatcccatctccttggatttatattgattgtgggtatggcttagtggtgatgggggaaggggtctagttctccaggaggaactcaaaggaaggcagttgtatagaaccacagaaacatatagaattatagaataaagtattctgagcagctaataagacgaccatttactactttgccacacagagggaaaagaaggaaaacagctcccaacaaggaaaaaaaaaataagtacccaatggtcctcttccctcttttgagcatggctgttgtttcggggtttttccaagccttgttttttttcatcaattattttctttgatgcctacttcactatgcatgggaacagaaagcaaactattagaaattttcacactgccagaagttcaacaaatgagtctacaattcccaaggcccagggcctagagaaataccagctgaaattaaaataaggagaaagagaatcgataaagaggttaattagcttatgtggtacagtcgagggaggcagagcattttgctgggaaatagccaggatgtcccaatggggagatgcaatcttcttaaccaaacgagatgcctggggaactcttttctccaatacttcatgaacactaaaaaacaaagccacagatacaaaggacagagtgctggccatgaagaatcatggggagctacttcataaacactttaggaaatactgttttgccctccagccaatttcctctaagcttcaaggtcagaaagaactttacaaagggtgactagctgaggagtcatccaatttacttcctactgacccaaaagagaagccatttattaccactggcaggaatggatgaattctgaccatccccattctgacttgggagtttctttttgactgcagtagggtatttgagtttgaggccagggatcaaaataaactgaatgctcactcaggacagaagagtaacactggccccccatgaagagagtcctctgcacttccccaggggtgagtgtgtgactgtatattttcagtttggtataaaaacatcaggagcagaataactcacctgctgagagacaggtctacttccctaggtctgaacatcctttccatctttctttaaacttaaaaagcacctattaagaactgtttactctggttttaaagtggaactgacatgacaagcggctgcacagaaacaggccgagagaggaacaatgaagtcatgaaggaggcagccctgggcccatttcatctcaaaagaagactgctcaccactgtatgctactctgccaaggtcctagagacttagaagaagcaaggaaccatgctgtagaaccagggcaggcggtactctagaactgggaattcattttccacaggcttaatgtaaaaagaggtttaaatgattccatgtaactggccatcatggcagcatgcaaatttacttagcattacaggagtccaaatttcagctctaaccctaccagacatgtgaccctgacactttaaccactctcagcttcagtcacctcatctgagaataacatctccccatctcagataggaactgggacagagtctttgtgaaatacaaagcagatgttcatgacataataactattgctgttgctgtagaccttgtttgatagtatttatgctcatcacagcactctgtccttgtgatctggcttctcagaatggaaaacaacattctaacgtcaataaaagcatgaagaacatgtcaggtacttgagaacccatgccactttcaaagcctagctggggttcccaccagcaacaaagagccaaaagcactgtccgccaagatccccttctcttgggacatcaacaccccattcatctttgccataaactaagccacacttgatgtgactttctggagagcaggctactttttcatcccagctcagattctgatggcattacactgcccgtggggatggaattccacacatgcggacagagacacagcttctcaaaatccctcaatatcaaactgctgttgagattctgatttcattgctgatgaatctcattcctgaggtacaagtcacagagccttttatggttcctgcatttggagattgtccctagccactacagacaaacacatcatcttgtgcttagagactggtgcttttgtccctcatcttcatttttccaccacagtgatgatggatgccctgcgatctcatgaagaataatgacagcaaaatgaaaagcgtatgtgtcatctctgggaagacacgtgggcagtaaaatatagctgtaccaaggctttgtggccataactcctaatatctctgtgcaattggaaatgatttttaaaaacctttatgattaatattttatctagaactcctaccactgtggaggaatagaacaaagaaaatgcacatcacaaagggccttcagcatcaataagtaagaaatctttaaagagctacactatctcactaatgatttccctactgacctgaatcaactttcagagagaaaatgcaagtaataaaggcctaggagatgggaggatgactcatttgtttcttcttctagctgttttctaattcccctcacctttttccaatgccccatgtcaatcaaagaaaggaatgccaacaggctctcctcacaactgcctgtagcaactacataaggaacccacgagaccagtaaagaaaagccaagtccagactcctcttggtcagggtcagccaagtttcaacttaaaatagataaaaaggaagctcttccaagtcaggcccaatttaggacttcgctccatttcttccagggacaccatgccaggacctgccctccttctgcccactccacctggttcccataatttttcttcctgttcacttgaccctctaagaaactctggaagtggggtttatcctattggtgaagtatcagctaagacaattcaatgatgataatctcattataatcccagtaaccaatttaattaatttactccttggactgctcagaagttcagtctctctcatgtacacacataaaataatcagacacatgtgcgcgcacacacacgcaaacacgccactgaaatttgacttctccttacaaatattcatgggtctatcaaccttgtagtgtgctgtaataatctacattttgtgattttcctgtgcacagcttacatcccacaaagtcaaggacagtgtgttttatataagagagagagagagcatgcacacgagagagagagagtgtatgtgtgtgtgtatatggcacatagtgtgtactttataaatgttgggggaataaatctcaaacctggactttacattcaggcagagtgttgacaaaaagttggaaggacagacctaatatttaaacataacctttaaccagaaggcagccacatgaatctttcaagagtcgccattaggaacgcacccacggctgatgggataagactcaggttttagggttaagtaagagtcagcagttgtctattggcaattgataactattcctgaacactctgcctggtggcctagaagctgacccctcacaggagtccagtcaggaccactgaagatatgaggagcctctaacactaagcccttgaacaaagaaggtggaaaggattccagtgccttacattttgcttcaccctcacgttggaaagaccttaacactcacaaatggaaagaaataacccaatagattactatacaaaaagagggaggagaaaacaaattgcctggctaatctcatggccaacggtaaagaattaatagaaattaaggcaaaaaactggaaagtggtatccacaactgaaaagcacaacctcttaataagccaggcaccctttataatatcatggaatcataattctgaactctgtcattgtctgtttcattgtccttgtctgtccctcacccagtgctcttcaagagatccattacatccctcttcttgccctcatttactaaagccctcaaggtattaatctgtagtgcagagcttggctgttgcgtgccatataagaggatgtgacaatcctttgcttgtccaacctttagttagccttctgaatctcctcctaggcccatctatgcacttccttgtaaaatccagttttagcaaaagaaccctgctaagtcagtttagctagaaccacctatcctcaatagctgataatccctgttatctgattatgttcctcatcctccaccatgccccaggtgatgtctgatcacccgggcttgttttcagcaagagtcctgttaggttgcttagccagaatcccccttaatcctgaagtttcctcttagtaggtttccacctgctaacccccacacagcacctaggctataaattcccacttgctcaagctgtattcaaaattgaggccattatttctctcccgctgcaagatgctattgcaatggttcctgtgcctctcccaatgaccttgaataaagtctgccttactgtgcttttcccagtgtcactgaataacttttttccctaacagatgaaaacctggggaaatggcatcccttcccatccccacctcctccccaagagacacacacattttaatgaaagcattaatttccaagaggggaaggatgtgttgatttggccggggtggatggagagagtgactagggtacagaggctcccataattaatagcatctttgtactatgagttctgtggagctaaattgacatgctcttgagaaaacaaggggtttgagctcagctcacaatggtggctgcaccatctggtttccaatgagttgtttttagctaaattttcagttaggctcattaaaacctaagacacttcagtgtttagtttaaacaaatgggctcacacagcccattttaaaaactcaatagaaccttcctttcctttaatggctaaaatgctttacaaaattccttggggtcaaataggatgtttttccaaagctagttgtttaaagctattcctaagtaacttctcacaagataacgagggttattaccgaaatattgcaaattttattttcaaatattttcctaaagtttctcttatataaaggtttatcttacattaggtattttaataaaaacctatcaccactagcaacagattacttaaaagcttatgagtcacatttcaaagagattttgtcggctctcctttcttcctctatcaaaagcctactgtgtggaaggattgaggtcctctgcctggtctccagcctcagctttggtgccatgcctctcctcccaccttcacccatacaaggctactctcttgccctttgtggctatagcatttctcccacccttctatactatgccacatctttacacctttgctcatgctgattgccttccctttttttgcttagtaaacagacatacatattttatgatccagcccaagcattactttctgtgttcaagtcttcttgatatttctccccaagcaaaatcgattgcttcctcttctccttatacataattttagtcacaacttcccacttacttatttgcatgcctgtcttccctactaaatgtcaatctactttcaaacaagaaccccagcaggaatgataattcctggtaagtaatcaagaaatgtttgttggttggatggatggatgatggatggatggataaatgaatatcatttttgataaaatcaaggcaaacagccatgtcataattccgagtgtaaagaaatctattttaatttcctgtcttcctgtacagagtatgacttccttgtataaatatgactcattcattcaacaactgagcacccaatcctatgggtcattgcttcaggtggtgtggctacagcaatgggcgaggcaccctcttctaatgaagtttgaacaaataaataaacaaatgcagaccatttcagataatgatgtgtgttattcagagaatcaaacaggagagaaaacacaagggctggatggtttgccgggaggagacacaaaactttggtttgggtagaaaaatcctctgtgaagaggtgacatttgagctgtttcctggataacaagacgccaggttttatgaacaactaggatcaaatatgaatactattatttataaccttttcaatcctaacccagcagcggggtcagtggttagccactctgggggtcactgggagcaagatagtgacagtggcctcactctgctcacctctccaagggagttttcacaactgtgctgatgaaccatgctagagtgagggcagactgacctagacctagaggcttaccttcccttcgttttgtttagaaaaactgtctgctcagtttgatttcactgacctttttaataaaacaaccagatttagtgtttgcctgtcctcatgtacccctcccatcacatcacaccccaccccaccccactccacctcctctgtgatatcagcctgaatgtcattcttcatcactttcatctgaaagtgattagattgacagaaagaacaaaagctggtgtttcacatctcaatttgtcttgtcccccagagtccataaatcaaacaaaaattctacacagctccttaaaatactctgaaagataaaagatcaatgtctggaagcaacttctttcaggcattcagaacagaagcaacaagtgagaaataaagctgcccattcctaatcttggagtagtttttcctggcttctcaagaggagtggcatttgcaaagctctgtggttaaagcactgtggaaagcagttgtattaatatacttatgaagaactgcaaaaaaatgccagttcgttttttactaagcagtcagttgcctaccagaaaaaattcttcccttcttccttgatgagggaacctcaattttgttctaatatccatgcctcaataaaaccacactatttctggtttttgtttaaatcctggtctatcctgataatcccagccctcttgcaagtgactggtttaaggggtggttgtgacctgtatgggtcaatgaagtaggaggcaaaaatccattggaggtgtctggaaaattttcccttctgatgaaacactcatagaaagagacagcccttttcatagtgctggacattatcatgcctgtatctgacacatagaacttataaagccatattgactgtccaggtaagctagcctaaagagaagctaaaagccttccaactgaaaactgctgtcatcttgaaaattcaccaggctattcccagccttaaaaacaagcaagttgggataaacttgaaggtctattccagctcaaaaagtatgggattctcaccaaggcaccttttagtgctattttagttagtagagccagtgttgacatatgtgatgctacttgtaaaaaaaactctgccaggtgaccagagactcatagggagttttgttcataggaggatatgaattgggatttgcatgcccaaaggctttcaaatttaacttttggaataaatcaagaatcagagcaggttaaggaagggcattaggagaaataagacgtttacactgactgtaccagactgcaactctgtcaacagagaggaacaattttgagagaaaaaaaggagggggttttcaaatttcaatgatgttgccttttaaaaaatctccatttattcatttatccatttgacacatttttatggaacacctacaatttggtaggcaatgtctatatgcaatgatgtataaaacatacttttcctttaggaatttttcctttaggaaaaattctttcctaaaggagtgaatagtaagttcagtgaaggtcatagaaaagtaaaaatatattacagtatttctgacaagagccattattagaagaaagcccaaaggagtatgggaggccagccaggtaaggggtgcttaccctaggatggagcaagtggtgtaggaaaggcttcctatggaagcaacccttaaactgagacttggaggaggttatggagggcagggcgggcagaggcctggcacactggcaggaacacaaatgttttaataaggctggagtactgggtgtgaggcagggagctgtaaagctagagaggtaaaagctgggaccaggtcacctgaggcatgctacggagtttgtgagattttattttatatatgtatgtgtgtgtgtgtgtatatatatgtgtgtgtgtatatatatacatacacacacacacacacacacacacacacacacacacacacacacatatatatatatatatatatacaccccttacctggctggcctcccatactcctttgggctttcctctaataatggctcttgtcagaaatactgtaatatattttcacttttctatgaccctcactgaacttactattcactattcactcctctaggaaaagaattgtatgttttatacatcattgcatatagacattgcgtaccaaattgtatacacgtataatacacacacacacacacatatatatatattttattttcagacggagttttggtcttgttgcacaggctggagtgcaatggtgctatctcggctcacctcaaccttcgcctcctggggatcaagtgattctcctgcctcagccccccgagtagctaggattacaggcatgcgctaccacacccgactaattttgtatttttagtagagatggggtttctccatgttggtcaggctggtcagtacttgggagcagtgtgaaacagaaggaaatttgtctgcaggtgctttctaaggcccccatcccgggttccctcacactctccagaagctctcaaattagaaattctataagcttgcttctgctgtggaatcaatgaatgtgcacagcttaaagtacaattttgtgttttaaagggggataatctcttaacacagaagaaggaagcgatagccctgcaatggtaaggggatcttggagatacatttagatgaactaagtttacagttaaggagacagaggcccagaaacactgtggaatgttctccgagttcacccatggtatttcagacccctgccatgagagaggtagtgggtggcggggctcccttcagaggctgctgtattaggcccagtaggctgccaactactgagaacagtcaccctttccttacggaacaccttgaccagaagttccacgtggcatggcatggcacacaaaatgagtgctcattaggcatctactagaagaagggaaaatcctgctatttctcatgcaatttgagaatgtgaaagtgaacccgggtactccccaaatgtaggcaccaggaagcagaatatggtgcatgagtgtattttcaaaagaaaaagctggcaaatgacaaaatccaagaaaattggcacagctgcttgccatttgaagaatcaaaaactgaaaatatttcaaataataggagaaaatctagaggaattgtgacttaggaccaatttggataggatttctaagcagacaatgatcattttaaagatgtgtggatgctcattttcaaaacctacactgacttctttttagaagagccacaggctagaagagccttctcagtggaactggattcttttgtctttaatgacacaacaggtagttacatgaactgagtggtctcagacctgcattaatttgggcagacagagatttcaaaactggtgaaaaacaaaactggaagaaagccactcttaaagtgtttaatttctttgcatttgcaattcaagcagatgctaccaacaaaatacatatgcaagaatggttaaaggttgcaagggaatggtaattaaaattatctttgtaaggtgattcattttgtgaaagctaccagggatgtgataagccaatattaatgtaattaatcaaggttactggggaaacagagggaaagtggaatcttaaaaagagactggacagtggttgagtcctaaggagggttgatctgagtcactagtgattgctttaaataagcattatttttttttcctttttaaaatcatgagaagggaaagaattatcaaataagaatctgcagttggctgttcagttatcccatggctcctggggtccccagacatagccggccaggctgtcatggcacctccaattcagatacatgacatggcccagcatacttccaaatgcaatctagaatcaaaaggtggcagatgtaaatgcggcacgggcccaggaagctgtcagggttgagagaggaaaaaaaggagggaaagaagaaaagatggggggaagataggaggaaagagaagagaaaaaggaagaaaatagcaggaaaggaaaagtttctcttccacagttgagatcattgttgacaaaggactgtggacttgagttttagaaaatgaaacaaaagtattgtaagctgctaacatttccaggaattaaattgtcattcaccacccttcccaggaggtaactgctaaggagataaaggattccaatattattttaaataaaaaaagcctacattagggtctaatacataagagtgggaaaacaaagcaaacaccttctggaggaatctttccctctcagtttcctttcatcttttctcaaagtagagaggaatgactcttccttaggttgcccccaacccaggctgtcacctgggcacacagagaatgactgggctcctctttatgcatttgaaacgcctacttagggtcttcagacctcattatgtcactctgctccactgcacgtctgtgagatttgccaagttatctcattcaacagagttgtgaaatctgcatgcttccatgggaaaacctgagcctttgcaggaatagagtacattttatacaaaaggaaccaagcagaaatttggtaaaacaatctgaaaaaattatagagtgccttgaaaacacttccttcctctggcctttcttgagaaaccagaagtcagtgtcttccaagtttaaaaaatcagtccagcttaagttaaaccggcttccttctgttctccaaagcagatgattatcatatttgactattttcactcagagtctgttcagaacagcctggccagtgtaaaatccaaaaacatttcactctcagattgccatgtaaaatgcctctcttataatgagaagcctagacaaggcaaatggcattttcagcattataaattttttcctcttgataagaaactggcacagataaatccatgttctatttcttaggatgcatttaacttttttaaaggattcatttaaaaattattattcagaatgtaaattacaggagagtttttgatctaaccatcttagggttatagtagtattcactcaatctgagtcacggtagaagaactggtaagtacagaattgacatcttgctaagaagagccaagaggttctcagaaatccagccaaagctgctggtgtaagggctgctctctttacctggctttgttcaatacagtaccaaagaattcctgcctcagcaggttctgagagaaagtaaagggccagtctcttccaaaatgaaacaagatacagcaaagggaatatacttaattcagaaaagcagcttggcaagactgaaaggagcctgaagtcaaaactcagagactcccaggtctgatttatccttctctccattggctacatgttcataagctgaatgttccagtcatgggaaatggacgtgagttcaaaaatgtgctagtgtgactgtaaaatgctttgtcctcatctttctgattccagagactaaatacttatatggaaatcagcctattaataacatcttatcgtaaggataaattacagtgccatccatgagcaaaggactggcaattatctagtgactacagccttttagatagggcaggagaaataaaggcaactttttacctaactgatatgtgaaaggaaacagagcaaagttctccacgttctccatgtgtcagcttcctcatctgtgaaactcgttcatttattgaacaggtttactgagctcccaccatttatgccagggtctgtactaggacctacggattcaacaatattcaagaaagacctcatatccactccctgccaattgcaagccttgctgatggccccagagcctcagccaccctttcattcttcatcagaagaaattcagcatgacccttccattgcaccacatcaagactacactctgaggagtccttctggaaaaccgtctcaaaacttgagcctgattgggagttgatttgctcctcatttaaaatacaacccctcctcatagaatattatgcttcccagtgatacagtctctcattgaccaaacttttagtcaggctcttctaaatcctcttcccaaccaggcctcgacttttggacttccgtgtgtgtctttatgttgcctaattttagcaagagtcctgacaagttggtttaggcagaatccctcacctttgctatgtgatcatcttcctcagcccccatcatcccccacgtaatatctgatcatcctagcctgccttcagccagaatcctgtgaggccagtaaacaagaattatccctactcccttagtaattttctatccattgacctccctactctgctacttggctttaaatctccaccctgccacttggtgtattcagaattgaaccctgttctatactaaggtctctttccctatattgcaaaggtcctgagtaaaatctctttgtactgctttaactgatgtccagctctggttttctttgataccagtcatccaaacctgagcatgaattacttcaatcaccccatgaaatctaacctcaagcagagactagctgtaggaatggagttttcttttgggagaaagacagagggaaaggtaatcaaagaaagaagggctgggtggtgtgctgcaagggaaggcattggacaggccagaggtccaggctccaggaagtaggaaagagaattggaagagggacaaaatagacaatgccagtgaagttacagttggcagctctgggaagtacttccatagccaaaacaacggctgctacatggagtgatgcaaattcaaaggcatggctctgtcacaagaatttatactttccagaagtatattcacccacaagtagaaaacttattttaccttcttttgcagagtaattcaattctcacttgatatagcccactcaagttaccaaagttttcctattgacatctcaatacaaaaatattcaggattattcaaagctcatttgaaaaacctcaaaaatttgtaattaaaagtacaaaatggcagcatgttggctacttgaaaaaaatcaaactataatttttcttacaatgaaagggagtaatactgtctgtaatttatttagagagtagctagtataatgcaggcatgcatattaaacactctctctttcatttcatctgactaaatgaataaatacattataccatccagacacacagttgaaacatttccccgagtattctttaaacacaatgtgcaagattgcaatggcatcatgactgacaaaaatgacaaagacgctgttaatcaagtaaatacaaagcagcagcatgaattatttatgccaataatatttgtaaccatacaaattatatattgatgttatactggagtgtttagtatttcagccaacatacatcacacaatgttcccccaacctcgatgtttcatttccttggatagctttaattcagtggtggcactcaaaacagaaccacagacacaatatcagctttttgttgctgttgtctcaaaatatgatttctttcttattatgaaatagttatcccaaaaagcacagctggggctggtgttacttcagagcttcctacatgaaagaccactgaaacagcctatgctggagagattatagtttcactttgcttcatgtttagagggaaggtgatatgtgacaatcactgctgaaatggtctttactgactcttgcatcaaggtcagaataaaaacattttaggggagggactactaaggcaattcttctaaggcaagaacctcaaatattttccttcattaacctaaaataagtttcagagaagtttaagtacactgaataactaggaagctttttacttcttcatctatgagatcagtcatacttacctatgattcctccatctcaatagaaaataaactcacacacccacacacatattcacacatgcatatacacccacatttacacacttactttgagcagttcaatttctgcttggaaactgtgaagataattatttatccttagttaaccccatctttctaagtttagaaggagctactcagatactgccacagttgggtaggtcactcactaaattttaagttccttaagggctgggggcaactgggtcatgagaatacccccgtagtatcaatatttacaatactgtttggttactaagttggagtggattcttaatgagcaattggaccacttaggaaaaggctagaagacagtactacatcttcctcactgacagctacttccctgttcatacagagatggaatgtatgtggagcaccactatagagcgactgttaacatggagaggaaagaggccagagagaaaatgcctggtgacttctccaaaaatacccacatcgttagtgaggcattcccacctaaatatcacaccagcaattgaaatcagacccaaagtaaaattcgtctctaatcgccaactatctttctcaaattctccttatgcctttacatgtgttaatttcatttcctgaaatacccatccccatcttttctcactcctctctcacccctgcctactgccccagctgtttcctgacaggtatagttgttagccacaaaaaataggggttgaatcctacctctataccactgtctagttggatgattttgggaaagttacttcacactcagtgcctcagttttttaatctacataatggggataataaaggttcctgcttcatagaggttaaatgagttaacagatgtaaagtgattacaacagagtctggcacataacaagtggattttaaatgatagtcattattgttcctgttatttcatttcacaatggtactttgcaagtgcatttaatacaacactcatttgtttacctttctggctctactgctaagctgaattcagggatatttctcactcactctgcatcctctgagtacactgcctgatacatggtagagactcactacatctgagagggagagattgggttctggcttaccctaaggacaagcttattcttactgtgccagggtttgaaacctcagtcttcaagttctgcaacaattcttttctaattgcgcacgtttcctacctgtgttgccaactctaatagttctagcatttacttgcacttctgcattattcttagaattttctaagagccagatactttttaaaaagaaaatagtaattattggcttcactccaagatcataaacatcaagttcaagctcccctgcctggtaccgagactcatttacaagaagatccagacaactttcaaacatcatttccatgacctatccaatacacaccctctaactcaccttgtgtgtcctgtctccaagcctatgctaaagatgggccttcaccctggaaacacttatgtccatctgttcaaatcttacttgttcttcaagattaaaaccaaatgccatttcctccataaaaacacttctcaaaattaatctctacctctcatgtgttcccagagcactttttatgggaaagctattttattaaaatatttatgactgttttgacttttgttatttatatgtattaagttcttaaaggaaagggaccatgtcttaatcatgtctaaatccagaaatgtgcctagaacagtgtgctacaacctattatatataactttcaaacccgaatttaaaagaaaaaattaattgacatgtaagatgctaggactcacatctgtttacaaaaaaaattagatttaaataactaagttccaattatgtttaattctcagaattacctttgagcattagattcttgcctgaaccccttaaagaattaaagtctgctttatgtgctttccttgacacaacaggcacccaaaacatttgttaaacttaattgttgaattgtttctttctgggaagttcaggaaactgggtccatagaaggagtccatatgattatagccaccacccggagatggtaaaggcactacgtgatgacagcgagagaaaagaatagacaaactagcttcctctgctggttcctggccaccatgcaaacacatgcatcacttacagactgtctttgactttcccccatcccacccgactggagccatgactggtgttgggactaacaaagtcctcctgttgaggtctgcagggcaaggtgtgggtaccaagggcttcaatgacagagaaggcaattgcagtatcaatctctggagaattccaagatccagaagccaggcctgagaaagaaatgttcacatttaaattatgagctagagctcttcagccatgaattgctaaggggtctttcctaagatggcaccgtacacatcgagacagttggggagccatgaaggaaaatccctgaagtgtccgtttggtcttttgatgctgtcccataaatcctatatgtttttctcatttcttttgtttttttctcctctgactgtacatttttaaataacctgtcttcaaattcacagattctttcttctacttgatcaattctgctgttgatgctttgtcttgcattttcatttccttcattgtatttctcagtgccagaatttgattttttttatttcaatctctgttaaatttctcattctggttacttatcgtttttctcatttcactgagttgttcctctgtgttttcttgaggttctctgaatttccttaaaaccattattttgaattgtttgtcaggcagttcatatatctccattttcttagtgtcagtcactggcactttattttgtcccttgggtgaggtcaggtttccctgattgtacccttatggccacgtactgatgtttgtgcatttgaataaatagatattccagtcttcacagattggctttgtctgggaacaccttcaacagcccaaccagagattctggtcaggacatctgatgtatgatcagaagcccatggctgctagggccagtgtggcgctcacacaagttagaagcccaggggagcaccagagcaagctgaaagacccaggccactgagacctctgtgctgctgacaactgtctaaattccaggggtgctagagtcagcccactagagatgcggaccagagatcaagtctgcctcaaaagtctaaagcctggagctacagggacccacctgatgccaaggtgagtctggaggttcaatctgtgggtaccagccatagtcttgggccatggaggccttcctggttctgggctttactgtagtgggcctggtgttggggtgcaaggcaaagtcttgtgcttacttccctctcttttcccaaagtggacagtatctttctgcattgtgctgcctggggctggggtaggggtgatgcaagtgagtaatgtagaactgtccctcctaccctcttcaatgcatcttttcatattatgctacaaccaggtactatgatctctcacttggtttcctcagctcttaagaaggtattttcacgcatggatagttgttcaaattaatgtttctgtggagagatgatcactggcgagtcctattcttccatctgccccctctccacagcctatagcttaataactttttaactctgagagtctcaaaacttgagactcaaagttttatgttgctcaaaaaacccgacctttttaaaaaataaaaatgtgaatagagccttaagaaagtggtatagaaatggtaagagatgtcatgacaactgataatgaaccttgcaaactatttgttctgttttggttttccaggagggacattagagtgagaatatctgtgaattaacagcctgatttactttaaactttcatgaagaagcctgaaacaacaatgaagacataagttttcctaagagattaagcactgtcaccccaatatcctgatttctctacctcatcttacagaatatagacatatatccacaaggagcaatatgaaattggagtgagaaagtgagttagcttccattttcaaaaatgtttatttctgtgtttaaagtgaaacaagagccccagggccctctatcccagaggaagaccaacctgtgagcattctttagcatacaaggaaaacgcttaacaaagggaaaggcacacaagaaacatgaacatcctcattccaattttctgtaattctcaagaattaatctgagatgtctggatttttcagggctgaaaagcaaggaacatcacatgaagctactccaacttatcaaaatacaatttattgtcagagttatagataaactgagccactctctctcaggttgcttatagagaccgagcccaggaaggactggaaaccacttcagaagcaactcatagctactggctgcataatgaatgagaagatatcttctacagccccttgagtctcagccaagcatcacacaagccaggagggggaagttaagaaaagtaaagtaatataaaaatgttataatataagatagaaatatggtcctagcagcctgagtttcaagtaattctcagatagatgaaggttaaattggcaggccaacatatatgcagctataaaatggacagcagaataaaatattgtctaataattcaaaatagaaatgtagaaaacaatattgtgactaccaattgaccacacaagttgatcttgatcttctcttctttaatcaacctcactaaattgagttaagaaatttaaaatggcataatatcctgaggaggtccaaataagcctctttctaaaagagacaaaatggaagggtgataattaatgaaacagggcagaagaatctacagtgtagaaatttatgggcaggacccaattaatcttgcaaaactgggcaaaacttgagattcttcgaaggccagagaatgagcatgagctgtgaggcaggaaaaacaaattatctgaaatcatgtatgtgaggcaaccaatcattaacccctaccctatgcccctctccattctgccaactaataatctctcttttttctcctccctctcctcctctccatcaacccagacaccacctacccccaaccacacacacacatacaaaaagaaatttggagcaatcttttaaaaagaaattggaagattcagagaaaaagcacattcagacaccaactcattcaaatatcataaaacaaagcccacatagagagtcacaaggcagctgtttaatggcttcactcttaattatgaatagccaatcatggttaccagttatatgaagaaagcctccaacaagaaagaatacaaatgagatgaataaatggaggaaatagttctgaaggaaatacacataagacaggcaatagaaaagaatttcaaaaatttaaaagagagccaagaaaatattataaccataaaacaagaagagaatgctatgaaaatggaagaagtaaactagaaaaaatcttactaatagaaaattatttttaaaattaaatagaaggatgaatcagaaaagattctaatttctcacaaaattatgacttgatttcagaatttgaagttatcataaaatgtgtttccatataaaaagaggaaaatctgtagtcccagcactttgggaggccaaggtgggcggatcatgaggacaggagatcaagaccatcctggctaacatggtgaaaccccgtctctactaaaaatacaaaaaaattagccgggcgtggtggtgggtgcctgtagtcccagctactcgggaggctgaggcaggagaatggtgtgaacccgggaggcggagcttgcagtgagccgagatcgtgccactgcactccaagctgggcgacagagcgcgactccgtctcaaaataaataaataaataaataataaaaaattaaaaaaatagaggaaaataaagaaactggccctctacaaaggaataggaattagaatggtattagacttttcaagagcaagcctgaagactgcagacaaatgtagttcctactgagaagttactcttcccctccactccattctcaacacccactccacaaatgctgaagaaaggagctggacgaaaataattttcatcttagaattctatattcatcctaatcatcaaccaaagatgaaaatagaacaaaacatttttaaacattcaaagactaagaaaagttagcccctccacacccttttataggaagatcattgaagatatgtacaaccaaaatgaaggagtgaacctgaaatgaagacaggatagttttcaggaaccagtggatctgaaggaggaacttccagagtgacaggtaagcatcaagcctagggagcagaaagatggaggaacctgtggaggaggggctgggaaaaaactccatcaaagtgaacttggatgtcggaaaatgtcaaaagtggaagctgtgattaaagggtcaaaagcataagggaaaatggcatttggaaattccataaaaacaaacagccatacgaacaagaaaattaaactataatgatcattagctccactataaataggtcacaaataatatttattgattttcaatttttagaattaaccttttgataaagcttaaagacttaaatgtacttacaaaataaaatgaaatatcatgatctgtattatataaaagtaaaaagaagtggagagtgcaggggtgccaagagcctaattttacaaagtagggaatctaaaagatactgtttggtaataaaaaattcatcaagatgcatacttaagaagtaaacttttaaactatgaatgtttattgcagtaaaaagtagagaaacaaaaaacaaattatatcatgtgttcggagaaattggcatgtgaggatatcggaaaactaaattcctatctattttagcagaaagtctatgctttagattgctatactttaaatgtgtccttccaagttcatgcaatggaaatgtaatctcccatgcaacactgttgagaggtggaagctttaagaaatgattaggtcatgagggctctgccctcacgaatgaattaaagtgattatttcaggggtgggtgacacaggataaacgtggcccccttcccttctctcccttgtgcatactctcatcccacgtggtgccttcagccatgttatgatgcagcaagaaggcccttatgagatagagccccttgaccttgagatctcaaacttcctaggctccagaactgtgagccaaaaaacttctattgtttataagttattctcatttctctataaattatggcattctgttatagcagcacaaaacagactaagacactaataaattaagaaacaacaataaaagcctatttcattgagatttgaagataacattcagaatagctaaaagagaaaaaagtagttgcttttggggaacaggttcgggaagtattaattagaaatgtgttacttttagacaaggcctaacactattttgattaaaaaaaaaacaaatttcagagaaaataatattgtaaatgtacaacgtatcagcaacttaccagaggagtttctgtgggctggtttaggaaatgaataattgtttatagcaggggttagcaaactaaaccctgctcagtgcctgtttttgtaaatgaagttttaatggaacacagtcacacacatttgttcacatattgtgtaagtctgctttctgctacaacagtagagttgagtagttgcaacagagacctacagactgcaaaacctaaaatatttactatgtggccctttatagaaaaggtttacagatctctgatttgaaacactaattttctgggaaaatgttatctatagccaagctgactttttaaaaagagtcaagccagatgcagtgctgtgcacctgtggctactcaactcaggaggttgagttggcaggatcgcttgagcccaggattagaggctgcagggagccatgatcatgccactgcactccagcaggggtgacagaacaagtccctgtctcaaacaaacaaacacaacaaaacaggttctaagttgggggctgcctctctcatgcacatatagctcacccgatggggacgaacatgacatgcctcgagacctagtgtctaatgttttctgactgggacatgtaaaaggggatttgtgggccccagttgggtatatgcacaagatccctctctccctttcacaataatggaaaaagtctgtcatgagactagaattctcctaacctttcagatgacagtaagaacccagcccttgtcttttaattgctacatgctgtccaaaaaagagcagcctttacatgctcacataacaatgaatttctgcttgtttctcaatgtggatatgagaatgaagcttatcaacatcaacataagtattcagcattctaggccaaagactcagcagctgggcattcaaagatatcctatagatacttatttttttaaaaaagataaaaaaaatttaaaaacataaagaaaccaaaaaaagccacactagtctgaatgccatgaccttggtctttctcatcacaatcctttaaattgccatataacctggaggtaaatccaattcatgggaagaccaaataggaaagtaagtgatagtctgctaaggaaaccattaaaaaacaggagtatcctcccaaatgacaaggggtgactttgcctaaattatgtattaagaattaatatcaaacaatcatacctcttagcattagctagttcacagtaggtctttctgcacagaaaccacttgactgtcaaaagaacttatgcttgtgacaaaaacttttattccatatctgggattctcagtggatatgagatgttagagggtatagaattgtatcagaatttcagggtggagggggatatttttaaatgatactgccccaagttagtgagaaattgtacagtactgagcactattattgattggagcctgttgcatacctcaggcaggctgatgaggaagcattacacaattcttctttttaggggagaacaagtcttctagcaggatttcctaattcttggtatttggatgaagagtttatatgcagacattattggacaaaatcatgtctaactagcaaaaagaaaaaaaaaacctaaaggtaaacaaattttgaaagtgggatgttaatctattacttctagctttaaaataaactaaaacaaaagtcatctgaagatatctaccaagacatatttttaatgagatcctcctataaagtgtttatagtttgcttttttctatttactttgttttcaaatatttccatgtccataaacataaaattctatatatttttaatatcttcatttaacatccttgtagacagtttaggcttttggtcaaattgtttttagacacagaactcctaggtcaaaggacttatacttttttaggatatttgataacagctctcctaactgatcttccaagaattataccgatttgccctcccactgcaaatacatgattgtgccacatagccacccccttgccaactctggctattggcatccatttccaatactgctaatttaatgactctcaaaatggttcataatttggtcagggctttgagctgctctatccaaggcaactattaagtgcacttaacattttttgacaatagcaatgacgatgatgatgatgatgacaaatgcctttgttctaagcatttcacacctatcatttacttaatacagcaaccctacatgggggtattatgatcatctccattttgcagatgagatgaactgaattacagagagattatttaaattgcccaaacctacaaagctaataggaggtaaaactgggattcaaacacatgtagtctggttctagactccttcagaatctatcttactcccccaggtatcagtacatacctactaatagttcatgcaccataaagaaaaagatccatccactcctgccctcaggaaatgttacagttctacagttctataagtgtgagctaacttgaatacaattagccaagtactttcccatctggaatctgttcccttttgaattagaatctatgtctcgcacgttccctcccggctatgtggcactcatgaatggatgggcaccacaccccatatcacaccagtcaatctgccacatccttctgcttcacatctcttggcatggccttaacccttgcctaggaaccagataatcatgtgagtcttgactgagactcaacagttctcacagctgctgaccactgtagatgagaatttttgaactgggtgagaaaaatcttgggttctaagaggcaacagaataccctgtaccaggctctggcttcctgggtccaccacttacaagttatgtgtctttggatcaggcacttaacctctgtgaacctcagtttttaaaatctgtgaagtggagacaatatttacagctcatagtgtgatgtaaggaaatgtgctaacatgcttagcactgtgcctggcacatactatattgttggtcaataaaagttattgttatttacagatgtttcaaatcttggttccttttgttattcctgttgataccaacttgaaaattatcatgacactatgaagtctaaactgtctctaaattaaaaaaaaaaaaaactgtatccaaaagaatgatctttcagagataaaccaaaagatgaaataaaagcatccatcactttaaaagacaatgttgatatataacattatataaaatgttcttaatatcagatctataagctttaagactatcctgttaccataaatcagagctaatactttattactgataaagtaaaaatagatatttctctattactatatgttactatatatgctgttatgttactataatgctgaccatggctctacaggaataacctagacaaaatctagaacactcagtaaagcagatggtgcttaggaacctactgaataaacagtctcagctacactttcagtaagtatccctttggagaagctaaggaataatcatgtctttatggaatggcatagtattaaacaaaaatagattttatctattagtaggaaacattctggttcaattgagatggactagatctagggtccccaggttttgcttggatagaagttactttctatttctctttggcctcaaaaaaaaaaatggcagtctgaaggtaaagcattgtaatagaagagaagaaaggtcggtgacagcctcccatgccctttctcatataaaaaaccttaaagttggtgaggaagagaaatggcattacacagtcaacaagctttgaccatatgagaccacaatttttcaactagaagtttcctcagggtagcacagtatataagaactttgttttcaagacagaggttagttcaattctggtgctgctatttatcagctgtgaaatcatgagcaagctatttatcttatttaagtctcagtttcttaatctacaaatggggatagtaatagaatctaccacataggacttttgtgaggattaaataaaggaatacactgtacatacagtgcttacaggtgcttcttccacaaggaatgggcagtacactttaagtattatttatatttctgatatcccaacagttaacactaaaccgtaccaagtatacattattttgctctctctcacacaaatatacacatatataaacaagtcacacagtcccaaccctgaaggtcaacgaggatagtgtttgctacccttgtagagtacaatctttaaactgtgatgacaagacaataaattttcccaaccatttgaatgagctttggaagtggattttttacttgagcttccagaaaaaaagcccagtctggctgatgccttgagttagccttatgagcattgaagcagagaacccagttgagcctgactgaattagtaactatagaaatgtacactaagaaatgaaggttgattttggccaaaaaataataataataatggtaactgtgataatgtgaactggcatcctctcccccacttacagcagacttgaggttaatctagagaatgaattttgggctagaagaaatcatccagtccacaatcagtgtcttcaattctagaatcaattgaaatatttgcttatcatcaaaataacattttcttcaaggcattagtccaagatctgtatcccagcgaatcacaaagaggagaaagaagagccagcacagagtatttataggtcactgacttggtgcacagccagaagattttttttaaccaacatttctgccaaaggaactatctgcagattctcttaatggttttttgtttttttttttttttttgagatggagtttcgctcttgttgcccaggctggagtacaatggcgcgatctcagctcactgcaacctccaactcctgggttcaagcacttctcctgcctcagcctcctgagtagctgcaattatgggtgcctgacaccacgcccagctaatttttttgtatttttagtaaagacggggtttcgccatgttggccaggctggtcccgaactcctggccttaggtgatccacctgcctcggcctcccaaagtgctgggattacaggcatgagccaccacgcccggcctcttaatcgtatcttaaagcattttaaaaataacaaatgaaactgaaaaagataaatcgaggtatctaagcagttacactgaactcatttctgaagctcatggacaaactatgtaaaatctcaagagactgaaaactattttctattctcaagattcaaagtaaaaacttagaatacaaaactctaagaaagagaaggcagaatggtggcagctccagagggtgggcagaatcctaatcttacaacagacctgggcaattgctgctgttaattctaccagcagaatgatgtaggagggctccttacagcctgggcccgccttatattctctgcacaatcagagtggaacctgggcacctattagtccctttccatgctatcttcctgtgaagattcttatgaataagaaaacgtgacctttatcaaggaataattttattcaaattgtgtaaactggatattttccacagtttcttgtcaggaggtgggcagagaagttaaattttatacctactttaaaaaaaaaaaaaagcccctcatgtaatgttagcaactgaccaaatactccttggatttcgtgtctggagagaaggaactaagaaaacatacagttctctgaaatgtttcctggattctttcctctttttccacaaaaatagaactactctttttcttttttcttttttctcttttgatgggggatgaggattatacagaagatttggcaacctaaatgaacatgagagaaagccaatagtataactaaaggaaggggatcgccaaaaccattcacttaggggaatttcaaactttggtgctaaagcttccaaataatcagcatcaccattcaccaaggagcagaggagttcggtcttgctgactgccagttaagggctctgaaaaaagacagtctccttggcagccgttccaacctggctcctgccccctgtgaaccaaggaaaagtggaaatctaattccatgtagcctggaagaaaccttacaggtccagggctgtggagaggtcgggtgaggaacaggagttcccaccatgccactagggttctggaagccctgggaagctgccagtggcactgcagcaccaggaactggttcctagagaactgcctcaaatcagacacacataaggaagtcaggcagtgatggcgctgcatgggaatacaagcagaacaatctcctcagaactacttcgagggtactgtctctcagccatcttccaggttttccacaacccacaaaggtctttcaggtgggtataatttggggttacttgttaagatggagttacagcacagcttcattggcaaagacaatgggatctcatatctagaaacaaaactttctgggtttcaccatttgcccgttatcccctgagaaacatcagcatcacctgttaacttgcttgggaatgcaaattctcagacccaaccgagacctatgaatctgaaactctggaggggggcggcagggaggagggcaggaatttgtgtcttagcccctcattgttaagattctgatgcacactaaaatttgagaaccattgagcattctagagcaacacaatttcatgaaaaaatagctttggaaacagcatctggatattaggcaaaaatatgtgcctgaatagaagaaacacactccgttcatagtagggttctattccccaattttttaatttagtagttctttgtgaaaaatgtcctctcacatgcagcattttaaaatgagaaatctggggccttctcaaccaacttcacacccgctttccagggcagctcaaaacaaattactgataaatcaacatggggcactctgaatcatcagtccgtctttagaactccccacatggtcagctgaggcattccattgagaatgcatcatgtcttgacttctctctctggccaatcctgccgtcattgcatttcttaataaacctcctgcatgctaaaaaaaaaataaaaaataaaatcaaatgagcaatttattgcaaatagccagtcccaaagaaatccttttgcctttgttgtttccctcaaaattgcacattatttaaggggcctgtcttttacacatttttattagcacctagagcaatacaaatcctccacaaactctagcaaatatgtattaatacagtaataagtaattctaagagcaagcactcaaattagtaaggtctggtttcctgtagattactaaagcagggaaggagtaagggggagaactcagagaaagcgtgcgctgactaaaagacagaaaggaagcagaaaatttattctgagcagatgccaagactttgccacatgcttacagtaagagaaatggagagcagagaaaattatttttaaaaccttctttccttgagaactaagttatcatagccctgctttaagatattaggtaaatactttttcaatgcaagacataggtggacccagaatattagcaagaaatgtgccttaaattatttaaaggatacagactatttattttccatggacaggaatcatctgtcttcattcataaaattcaagctgataattttttgataaaactgttttctttataaattgttaataaataaataaattgttgataatgtatcatttctacccaagactggaacaaacacatcagccacttaaattcctcagcaatacttaggctgctgaatttgttatcagtggtaatatatgttagcttgcctgactttaactgcatctcctcaaagaaaaacgtagatgagaaagtaaaagtgtagaggtggtgtggtagagtggaaactgatgagcttttccgaagtagagctggatcctaatgccagcagctatattgttatgactaagttaattgacactcaggactgttttctcacctatacagtgaaggctgtggcacagtttaaatgtgttcatgtgtgtacagtgcctgtaagatgataaacaccaaatcagtattattattattaagaggcacccattttcattttaaatcaatttattagatgttaataaaattaacccctattcctccattctgccttccattatttggcagataagaaagctctggcccaattgttctcaactctggctgtatattacaatcacttgaaagttcttgtgtgtttttttaactgccatctcgccacagaacaactggatcagtgtctggggcaggccccaggccttggtgattctgatgtagtcggagagttgagaaatactattccaaatggattctttaccaaaatcacttcggggcaaattggctattctggaatttgatcatttgatggtttggcctgctcatcctgaaggatcaggaggatacagccttatcctatcttagcattcttgggagatgtctagtacaccctatggcaaaataaatactattccatatttcctggttagcctttgctggggagagaggggagaggggtatatgtctgatgatgagccattgaaggagaacatctgaattaactaaagatggtggaagagacaaaagattaggttagctattatactttaaaaacttctccttctcctccttcttcatccaccactgtaacagatatctgaggagtccctactatagtacttagaaaactaactgaaaataggacaattcatgaatgccctgactcgttacatggaaattcaatagggaaggatctattcaggtatctctggaagaagaaggtcttcccatacttctccacaatttaagtcatttttcatagtctaagaatataagagtatatattgtacagcctgggcaacatggtgaaacgccatctctactaaaaatacaaaaattagctgggtgtgttgatgcacacctgtaatctcagctactggggaagctgaggcacaagaatcacttgaacccaggatgcagaggttgcagtgaactgagattatgcccctgcactccagcttgggcaacagagcaagactctgtctcaagaaaacaaacaaacaagaagtagacattgtaaattgaaacataaaactttagaggcagaaatgtcaccttggagagcaaacagatatttaatatttgttctcaatcaacattacctgataccagttaccagccagggttatgcaaggtacttctatttacacaatctcatttatgacacaatgttgtagtttgaagagctctgtgtgctgttatagtcagggagtcctcttgtaatgatcaattgctacagcaatttaaaccttctttaacttaggtttatgatgctagaattttactttttgtattcatatctgtttttatggcgtactgttggtaagatggtttatatgatgccaagtctttggtcagaaaagatgctgctttcacaatgttgttctcatagaaaaacataaatcactttgtggtattgtttccaagaacatgctaaggcaagtaggggttttccctacagtcctcagggcaagttcaagattattctgggtattatatgctgctgcaaatatttcttcccataggccaactgaaaaactcaaaacaaaacaaaaacagaaacaacaaaaaaaaccctcaaaattgaacaaaaattctcattttcattgttaagaaaattttcaactattagttatgttgtcaagtcctatttttatcattgattcttttcaaattcaatatatctaaaatgtggactcagatgtatctaatcaactatttttgcagcttttcctttgcttttaatgcaaactctagaataagaacatttaagaaggtcaccccagctgtgcacaacctgaatccaacaggattccaacaggatacttggctttaacttagaatgttggctttaacttggagtaatggcatggaagtctcctaacaatttccactatgtgttatgaataatctagaactttactggagattttactctattttacagtgatatggctttaaaagactataagttttgattccaaacaaatctagtgcaatagcaggtcaactaaggtcttgaatttcatttagtattttattcgagatcagtatttacagtactgacaaaactatttaagatcatcaaagtcagtgaactccttcctttacatttatttgatatataaagggccaaattgttcaaatgatgcttgaagtgaatggtagaaccaggctagtcatttcaaaacaggatgctgctataaagacacatgcacacgtatgtttattgcggcattattcacaatagcaaagacttggaaccaacccaaatgtccaacaatgatagtctggatcaagaaaatgtggcacatatacgccatggaatactatgcagccataaaaaatgatgagttcatgtcctttgtagggacatggatgaaattggaaaccatcattctcagtaaactattgcaagaacaaaaaaccaaacaccacatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatttaaaaaaaaaaaaaaagaaaatatttgggtggaatgatcagttgaacaatcaattaaaagtctgacccacagaaacgaactttccagatgatcccagatttccaaggaatacattggtgttgtactatccaccataagggctggtggcatgaggaacattcaggagccacggacaacaaattatgctgcttcaagaagtcaatggctggccgagtgcggtggctcacgcctgtaatcccagcattttgggaggctggggagggcagatcacaaggtcaggagatcaagaccatcctggctaacatggtaaaaccccgtctctactaaaaatacaaaaaattagcctggtgtggtggtgtgtgcctgtagtcccagctacttgagaggctgaggcaggagaattacttgaacgtgggaggtggaggttgcagtgagctgagattgcaccactgcactccagcgtggatgacagagcaagactccatctcaaaaaaaaaaaaaaaagtcaatggctggcagatttgaagcactaacaatatttggcagtgtttcttgaaataaacatttatctatttggagaagtagaatgaaatgaaatctttttgaaaaaaaacatttaaaaaattaaatttgaatttgactcatagggattgatcacaattgaagaatttgacctgcagggacgaattgttcaactgatccaataatttaaattataatgtatatgttctcattctaagcacacttccgagagcagcagaagcagttcaagaggcataagggaagcttcacaaatagctcattagctcaagaagtagatgaagtgggggtaagaatgaaaaaatggtgaatgtcccaaattggaagttagaacacctggttctgcaaagactaattgtgtgtcctgcctctaaagtagatattcaacctctcttggcctttgaaagaacctgtaaaaagagaatatgagaattatgttctctaagattctatcatacctttaaaaggctatggttctaagttaaattggagtttggttttaataaggtcttaaaaactcttcatctttccagttaaaaatgttcagtctcctgtaaatgtcactactgatctgatatcctgccatgacattccagagatgagacaggaaaaaatgtgactggctcatatagattctattcctatcctctcactatcctgactttgccaggagcagttcagttctggaacacttcagaaaacatgtcttaaaccactaaatttttagaatagggattcaaatttaaagtgtaagagaaggctggttgagctaggtggctcatgcctaatcccagcactttgggaggctgaggcaggcagatcacttgaggccaggagtttgagaccagcctggccaacatggcaaaaccccgtctctactaaaaatatgaaaattagccaggaatggtggcacagtcctgtaattccagctactcgggaggctgaggcaggagaatcacttgaacccaggaggcagaggttgcagtgagccgacatggcgccactgcactcctgcctgggtgacagggccagactccgtctcaaaaaaaaaaaaaaaaaaaaagtgtaaagaaaggcctcggtttaggtctgagcctaggctatggtttcccacctagctcttctaatacgattcatttgggcctcagtttattcctctgcacagtggaaaaaacgaataattttgatgaatggtactagattttagtagggtaggtaatgtttttaggatagaagtagaagaggatgggaaaaacagcttgtagcactttgggctcttgagaaggcacgtactactctaaccatcaacagtcgatcatgcatcttcctgcaacttattattcccaggtgctcaaaaatacctatggttgaatgatgatgacaaagcagatgtcaacatttaaatttggtaaacatctaacaggaagaagtgtgacatatgggaagaggttcaaatccaagccaacccagatttgaatcctaccaccatcattaactacagagagggttatttgatctaagacaaattacttaccatctgcaaatagggaaataattttttctcattgactctattttgagtattaaatgacatatcacatgttaaggtctcagtagagtgcctggcacacaatagatatgtgagaaatggcaattattattatatgtcaaaatgaattttattaagaaaaatcaaatatgctgaacattagattccatgtacctgctactaacatatcatgggctacttttaagcctcccacagtcatctttgtaatttgccagaatcttatctttaagaaaagacaatctctgcagaagataggtattaagtatttttctctccatctgaaacttccaaatcctcatcaccataatgactgaatgtacagcactataagcatgaagctcacatatttatggagataagaaaacaagtgtggcaaattataacagactttatggaacgagtcagttcaatgaaaacagccagataagtaggaaggaaggaagcataaatcagatatgatgaattccatgacaagcccatagcaccaaaatgatcaacgatcttagtatgttagtttacccataccataaacactccacctatttttttttagaattccatttcaacttacccattgtctttttagctatggcttttagcattatttttttagtgttgttttagaggatatatatccttaacttttcacaatctacttagagttcatactgcaccacttcacagaaaacgtgcaaaccttaaccatatattccattaacacatcctcccaccgccatagtactgtactttatgctatggctgtcatatgcattacagctatgtacataataaatcccataagataatgttatagtttttgctattaatcatatgcattgtaaataaattgagaggcaacaaaatattttttatttacacagatatctgccatttctgatgttctacattactccttgaaatagccaggcttccctctcatattatttccctacagcttaaaaattttctttagcatttcttgtagtgcagatctgctgatagtgagttttcttatatttctttttatttaaaaatatttttgcctctattctcaaaggacattttcattggatacagatttcttgttcgacaggattgcattcccccaaaccttctagaactttaaagatactgttaaactctctgctggccttcatagctccagatgcgtgtccatgatcatttaaatcagttaccttctatgttgtgtgccattctcctctgactgctttcaagattttctctttaatttttagcaatttgactatgatatgctttggtgtgacatttttgtatttatcttatctgggtttcactgagctttctgcatttgtaaatttgtgtttctcattcaatttggaaaaatttggtcattatctcatcaatattttttctgttccactctttctcctttccttctgaaaccttaaacacatactaggctttcattctgtcccacaggtctaggatcctgttcactttttaaaatcctttatctccgttattcatcaaggatcctttctactcatttatcttcaggtttactgaatctttcctcattacttctactgtgctattaatcaaacccatacagaggattttttaaatttcagatattatttttagatctaagatttcccttttgtccctttttatattttatattttcctgctgaaattccctatattttcacttatgtgtacaagaatattttcctttatctcaattataagagttgctttagaatcattttctaataatttcaatatctggatcatctcaaggttggcttctatccattttcccttgagaatgggtcacattttccaggttctttgtagctaaagtaactttggattgtatcctaaacattatgaatattgttgtggagactctggattctattattttcctttgaacagtgttaatgtttattttaacaagcaattagttttgttaaactgcaaaccctgtcttgtgtgcaggaggcaacagatcaaatctcagtccagctctgttaccattaactgtgctgctttgattttgtccaacacatgtatggctcaagaatcagccagactcacgcctgtaatcccagcactttgggaggcccaggcgggcggaacatgaggtcaggagctcaagaccatcctggctaacatggtgaaaccctgtctctactaaaaacacaaaaaattagctgggcgtggtggcgggagcctgtagtcccagctactcgggaggctgaggcaggagaatgatgtgaacccgggaagcggagcttgcagtgagccaagatcatgccactgcactccagcctgggcaacagagcaagactccatctcaaaaaaaaaaaaaaaaaaaagaatcagccagagacttgggcagagtttatactcacaatcttgggctctccttgtctgactctctcctttctggttttcccctctcactcgccaatggccacaggctccctagactctttcttcttgccactcagacaagaaagtgaggagtttttaatcacaacttcggctgccctgtgtcattctgcaaaaacagacaactcaccccactaaagtccttttttccaggtgcccactgctttacaaaacctgtttgcctacttttttcactttcaaaaaccttcaagtagttgcttttttgcattttgtcccaagtttattgttatctgtggaaaggttagtgtgttcaaagcttattccaacacactagaggaggaaaccacaaatatcctgattaacaaaaaaatcttttatctatatatcaagaatcaaacttgaaatgatgaactataggttggctagtcttcctgtgcctgcagaagtctcattttactccacgcctacaagattcacaatgtatcttctattatgcatttcagctcatcctcaagcctccagccaaacctggtctccatttagtaagtcttcactcccaagggtaggatgtgcaccactggtaaaccagatgacttaaggtgactgagacagaacattaaatagcatggaatcacataactatggggaaattattttcaatttttttcaactcttctgattctgccaagcaatgcatctcagttttgtggtaatatgtctttgacacctttctaatagtggctagtttccccttttcaacacagagacaacaggtctcatgcaaagaactttctccaggaaatagcatctagctagaaatgaataacattttttttccactcaatgtatttttagagttaccttctatttgtagtgatattgttttttatttgtgataatgacataaagtttactttttaaaatcaaaattcataaaaaataacttgatttaaagaaaaataataggccaggtgcagtggctcacacctgtaatcctagcactttaggagatcaatgtgggaagattgcttgagaccaagacttccagaccagcctgagcaacacagcaagagctcatctctacaaaaaataaaaaatataaaactggccggctgggcgcagtggctcaagcctgtaatcccaacactttggaaggctgaggcaggcggattgcctgaggtcaggagttcaagaccagtctggccaacatggtgaaaccctgtctctactaaaaatacaaaaaaaaattagctgggtgtggtggcaagcacctgtaatcccagctactcaggaggctgaggcaggagaattgcttgaaccagggaggtggaggttgcagtgagccgagatggcgccactgcactccagcctgggtaacagagtgagactctgtctcaaaacaaacaaacaaacaacaacaaataaaacaaaacaaaaaaaactagccaggcatgatggcatatgcctgtaatcctagatacttcaggaggctgaggcaagaggatcacctgagctgaggacatcaaggctgcagtgagctatgatcatgccactgcactgcagcctgggtgacagagtgagactctgtctccaaataataatagtaggccagtcgcggtggctcacacctgtaatcccagcactttgggaagctgaggtgggtggatctcttgaggccaggagtttgagacaagcctggcctacacggtgaaaccccatctctactaaaaatacataaattagccaggcgtggtggtgagcatctgtaatcccaactactcaggaggctgaggcaggagaatcacttgaacccgggaaacggaggttgcagtgagccaggattgcgccattgcactctagcctgggccacaagaaggaaactccatctcaataataataataataataatgaatgacagtataagtcatatacagataagaatggggaaagattgtagtaaatagttctaattgctataacagatgtatccccatcccaaatctcagtagcttacatacagaatttcttactcatgaaaatgccaataacgctacttgggtgtttctagtttgtggtagttatccatgtgttcattcagagattaaggatgacaaagtctctgccatcttcaacagagatctcaagatcactttgaataggtctggccagggaagagagagagagagagagagaggaaaaaaaaagaatagcagacagtgtgggcagtttgatgggccaggcttagaagagatatatatccttctgttcacatattactggataaaactgagtctatggccacacttcactgtgaagcaggccaggaaatgggtctgacctaggagaaaaagtgttttgggtttccatgagcataaagtttaggtaactgccctaagatttggggaactatgcactaggttatgtttcttcaaagcagaggagaagaaggaaccatcatttctcagaaaattctctttgttttataaggatgacttaagatattagcatctctccttcctgcctgccttccagatcccatggtcaggcccctccccaagaaatgcagagactgacaggcagtcctccaaagtgttctatccatttcagtagacctccaccacgggaatctggggtgcccactgcagctccaagctgtcacatctcctgtcccccaactgccctttctttcccagcagctttgtaatcacaatttaccaatcctgcctctcaccctctccacaaagtctttgctttctgacagttcaattaggtaacttgaaaaagtagccagtgttcatgttaattgaaagctctttcttccttctctccagggaaattaagaacattttacactgtggctgcctggaggccacggtattgttttgagtgtgtcctagcaatgtgtggccaccacagaccagggaggtagccccatctggctggggggcaactccaccaaccccacttcttgaatatctggcctgttcctccgtggccacccctcacccaagagagagtgccagctctttaaaagcaggacatgcccctcccaggatctttctttgacgcccacagatcacagagggcctaatgcaaggtcgagtactaggctttggctcaggacatgtaactgaattcaaatgattgattcagtgtcactgaggtattagcagtcatttaagttctgttctatgtactctaaaaacagtatatttttaaacaatgtagaacagtatgtgtcaaacctttagttactcccaaaatgctataattaaagagtcaactcctcatattttgtcagatcacagtagaactcatggacttccagccttctctcagccacgacctgtgcttgacccccactattttaaattcctgaactgttggcagaagtgcctgggtagatattaatttctataaatatgttttggagagaggcagccaaggcaaattaactggtgtttcatgagtacacccataaaatgctactctagtaaaaagggcacctgatactaaatcctgaacctacccttccccccaacacaccctttttaaaaatggaacccctagattcaaagacagtttggagtggaggttccccagataatgtctgcttgcttgttagttacattgattttaagaacaaatccatttaagcgatcttcacagctgacttgtcctctttccatggactgtgggttctggagccagactgccaaggtttcaatcctgattcaccaccttctcattatgagatttggagcaagttacctcacaggatgtttaggacttgctttaaaattcttcattcaaaaaataaaaggggtggtggtagagttactgaaataagatgggcaaaatattgataattattgaagataagtaaggtacaagtcagttcattctatccactctcttgattgtttgaaattttccataataaattcttaaatgacacttttatctagaacacaagtaattccccaaggctttccctcacaaaacaactttctcctctatcagagatgaattgtagaaaatatattgagtattctatctttactttcaactatgcagaacaatttcttttagatttcgctgttctcataagttaataatataacaggaagaacttaattttttttccttctaccttcagctgtttaaacctaccaagaaatcaaattccctgatgtgcagtttaccgcagtccttgcctcttatgataaggccagtcaagatcctaggtatctggacacagctataatttggtgtcgttttcagtgttggctctgagatctcagtctctcgataactcccctttccaaaaggggaaagaccgggggcggaaggaagagaagacaagaagagagggaatgtactgcatcctatttcaagcactaacacaactgttttctcccccattgactcttcaaaacacagatgccatgcccatagagaggggagacaaataaggcgatatgttgggctcaatatatactttcttttgcacccccaccccaactttcacatgtaagtaatgcactgagaaaaagagatgacttcctgctggagctcagactgtgccaatagaaactgctggtttccctcaagtgatattaataaaactaactttattggcaactcctgtcagggctgcacatgataacgtcaaaattgtacagattggggaaaggctgtttaaaagttttcccccaaattatcagtttttaattatatcccaacaaaatattgatgtctcttttatcactgataggtcatataaaatttggagacagttttcctctatgtctttgagaaaaattaaacaatataattttattacttctttcacatatcttcatcagctaacttaacatggatctgttaaagcattttaagtgtaaaaaatgaaatttgagttttatgttaaaaatttaataattatatcaaagtaaaggttagaaactatttaaaaccagttaatatcaacatcagagaaagaaaaagtatataatgacagttctaattattacattctcttgttttgcacttctaaagagtggcaattaaatctctactttgacttatgtggagagtaaaatctgcacctgcaatactaacaccatttcatttcctccaagaaagggatttagttccttacaatatagatctggggttggaatagtagatgcaaactgcttctagaatagcacagtgcctctgatgatttaggatggtgttccaaacaccacttggtttccattcaatatgaacaagtacaaaatgatcctttgagtccccaccaaaatcagtacaggctaaagtgtgtgttggtttctatctaagtactgtacatggagcaactgtagtttctgaggtcaggaacactgtcattcatggtcttagccttaggtatgccccttcccccaaacctttttctaagggcaattacagtgaaagcagtttgtaaaatgttaagcattaacaaatggaactttttttgcgaatattcacttgtaaaaatacttagccagactgatagtttgactttggggaaatatatgtctgtggcagaaacaaaaatgcttattaaatattccctctgttccctcgcatgttccagccccttgcagttatgtcagatcacgtgatatagttctgaccagtaacttgtggccagaagtgatttgtgtcccttttaggccaaagtgtaaaagagctggcacatgatcttctggctgtgtcctttcttatcatggtgaactgagggggacatgagttgcagatgttgtggctataggatagtgaaactgctgccatgggcctgggtccctgaatgactgtgtggaatacaacactactaccaactcttgctggatatgtacaataaacaaaatacaaacctttgtgtgtaaagccaccagaaattggattatctgttcctgcagcacatctatcctatcctgaaaaaaataatgtgtaaggtctaaaagccttaatttttcacctaaccagcttcacaaaactctggatgcttcatttctgcaaacttcttcccatgctgatagatgagaagggcaatatgcaaggaatggctccatcatggcaccatggtgaccttgcacatccccttataggccatagaggcaaagcttagccacagtctgaccgaagtcttggtgggatgccctgaaattcctcctgaaatgaaggaagacaagcagccttgtggggagctcctgtgaggcggtttctcatctacctccagattttgtgggagactgcacaagacctttcccatccatcttccttgttttggttgtgtacaggactttgcatcttgcaaacccccttccccttagggcacagccgcaggcttctgtgccaataaaactacttggctgtaatttagaggtggctcctctagggcaaagtgacccacctgtcatgccacctgtcttctggcctctccagtttggtgtcatcctgtgtgtgggactagggaggcaaggagctgatggcatactgatcttgattttgctgtctgtgtaagtaacaaagctctgaattcatttgggcttgttgttgccttgccagacggatctatggaagtgtggagagccaacatggtagctgccctatcagtgaccacactgcagcttgggcattgcttaactacttgatacaatgaaaggtgacttttatgataactatttgttgctcagcctcagcttagatggttttctgatgggatatctttcttttgcctgaaagaacaaaatggggccaaccaggactatagctttctgatttgaagttggagaaaaaaacaagtcagataggtttcccactgcttcagcttcctccatattttaataaagctagcatcaagtttacaaactgagttgttaggaggctccaacaatccaggccctattgaagatatttggtagcacctcttcttgacagagtcttaagtgtgctgagtggtagccacaggctttggaagaacccatgagagaaagtcaacacctaacgtacaaggagacaatttatggcatttcatacttctgctattccagggaaccagaaacacctatcacagggatgaatgatatctttcaaattaaataaccaacaggaatgctaacactaaatttcctgaatattaataaacacgaatggtacacaaatgcatttacaaactactaaacatcaggaattgtgtgagaaagaagtctcacaaagataaatggagttccatctttagatgcaaactcaaagttctctaagacgggtaatgtttctgacttgggagtgaggtccagaaaaatacacgctgggtgatgagtctttagatatgagcacatttataagtaactttatggctggcaaacctatgtacctatgaaaatggtgcaaccacagcagcattctctgttggcactcacacagcacggtcatgccctatggggccaggaagaacaggagtatggttttgcttcttgcaagtttacagatatcctactgagagtgagaatcatcatgacatatcttgaaggttgtaaggaagaaattttctcagaaagagaaagggaaaaatgtatgcatctgacattatttctggaaaggagaacatcctttccttataagacctacaaatatgctgttttaaagatgattctgggcagagaattgtgagtgaaaaaaaaatctgtgctttcaatataaatgatggtgacagaagaaatgctgcatgctgataaaactcacagtgcatattgatgaaatattcaaatatccatcatattccgagggaaatatcctaatgttctaagcagatactgttagacctcattaaaaagaaatcgtcaagtactgttctttttatgattttctcaaccacaatgtttttctagaccttcctttgtgccaggcatgatgttaggcagaaagggcacaaagatgaataggacacatgtctgttcaattggttccttgatgcggtttctgccttgaagctccgtttccactctttcctggttcctgcagtaacaattagtgttcaattaaaaggctctggtcttcagcaaccatcaaaataaaaatgattcaggcaagaattctcaatggatggatgtcaaaaactttgggtaaaggtttggatcgggagagtcacagggtcctcaaaatattaccccatggattacttactaattacaaaaaagcaaaggagaaatctctgcaatggagaaatctagtgggtaccagtttaaccaaggatttcaatttagtaccaccaagaatgggaggagcaaacattatgtgactcctgatgtgatgcaacaagaaggataagcattgcctacatggtgctctggcaatagtaattaactggaatctaactgtgttctaactgtgagaaagcaagcagacagatacagaatgtagaacactgtatcaaacaactagctggactttttttttttttttttgagatggagtctcagctctgtcatctaggctagagtgcagtggcacaatctctgctcactgcaacctccacctcctgggttcaagcgattctgctgcctcagcctcccgagtagctgggactacatgtatacaccgccatgcctggccaatttttgtatttttagtagagatggggtttcaccatattgaccaggctggtctcaaactcctgacttcaagtgatccgcctgcctcagcctcccaaagtgctgggattacaggcgtgagccaccacatccagccttagcctggacttttcaacactgcactgcattattagataagacataaatgtagggaactcttctatactgaagaagactaaagagagacagaacaactaaaggcaatgcatgatcctggatcaaaagaagcagctatacagtaatcatttgaactaatggagaaatcttagaagggactgtgtttaaatggcatattgtattggtgtcaaattccttggtatttaatggtactgtgacatgttcttgttctaaagtgataatgctgaagtacattggggtgaaatagcatgatgtctgcaacttactttcaaatggttcaggggaaaaaatttgtgtatacacatacatatacatacgtatgggaggagacacaaaacaataaattggcgaaatgttcacattgtcaaatttagatgcaaagcctaccagtgtacattgtattactctcacaattcttctgcttaatttgaaatgttctattttaaaaggggtggaggggagtgggggtgaaaaacagcagctgactgagcttgggttacagttgtgggtcatggaaaatggcaatgctaaggggccacttggatgaagcctgtgttcttggcctcacaagcctgtctctgataggggtcaggcctcatcttaatgacaggacagtccaggaggtgcattcctagtttggaatggatcaagacacttcaactgccacactcaaagagatttgtctgtttagtgtatctatagacttagaataaatatgcttcagaaagtggataacttctcacttgttatatagaccaaagtaaaatagcacaaaatctacaactcaaatactatgaagtgctcagtaatcaacttcaggggcaatgtcagtgcatctttgggtcaatgtgggtaagtgtacctgtatccttgcattggtccataaccaaaccttggctccaatgggaacccgaacattagactttaaaattttcttttgaattatgaattctttgctgaatagtccagagcataggccttaaattctggcagaagtcctatgaatgaattcattatatgttttaaaggaaagtcattaattctttgtaaataatgttttagtatctaaagagaaaaatcagaaggtgttaaatgtttataaaagaatgagaactcaaggtctaaccttctaccctctctcattgcccttttataaagccctttgcacctgcaggaaatatagagctatttccatttgagggtctccatctcctccaccatctgctccacatccagcccaagtctctcttgctcaaatcatctggtttccttatcataaacagtctttccagttgtgtctacgcaatgcaaaatcagattcagattataatgtgcttattttttctttataggttgtcagtaattactttatataataacaaaattgcttataacaaagccagtgaagctaacaccaacttacccaacatttataaagtcaagcaaaataaagtttttatcacacacgtaaaaaataatattcctcctaaacttaaacagaatcaaaacaactcttcacttaccttttattgttcaattatagtgtaaagtaaatagacagttactactaggaaaaaaaaatttaagttggagacagtcagccctgcctctttctatgcttcagagaatctgaatattcatttccatccttccccaaattccagactctaaatggcctaatatatgacattagcatgatttcaattaataatctatgatatcttcatgtcataaattttatttgaaattttgaaacacatatttcaggtatcaaagtatctgacactggtgtagaactgattaacataagtaaaaaacatcttttgacagcccatcacacatccttgtttcactaaatacagaaaattattatatatgtaaacatatgcatatagaatatgtaacacttcaacacattccaattatattactaaatgcttgcccttccatcaagaatttggggcattttatggcatggccttcacataaaaaccttagaactgagcatcccaaggctcaactcagacttttttcctttgcatctccaatctgtcaaacatgtatatttcactattcttctaggatcaactcttcaaaagctactaggtatgagtaaacactctatacatagccccctgactccacctgttttctggtggtgttaagaaaaatatcattgctagcctatggtcctatcctcagaggaaggcaacaccaggacctatattatgactgtgagtcaggtgagatagtccgaggcaaggaacctttatagagtgtagactggatatgtgcagaggcgctgaagaacaagacagccaacatggattcacttccactgaagaaggcccgggggaggaagggtgacctgagttgaaccatgagaggaggtgggggtgggaggaatatgtgaaggaacagaggtgagaggaattatgtaaaaagagagaccagaagagtacatatggatgtctgcagggaaacaaggtggccacagtcagatgagagttgacaagtggcagaaaaatgcctgctgctaggtcagcaggtgccaagaatgtgaaagccccacaaggaaagcagaggaggagccatggtgatgggggaaaatggggccattccatcagagaaatgcaaatcaaaaccacaatgagataccatctcacaccagttagaatggcgatcattaaaaagtcaggaaacaacaggtcctggagaggatgtggagaaataggaacacttttacactgttggtgggactgtaaactagttcaaccattgtggaagtcagtgtggcgattcctcagggatctagaactagaaataccatttgacccagccaccccattactgggtatatacccaaaggattataaatcatgctgctttaaagacacatgcatacgtatgtttattgcggcactattcacaatagcaaagacttggaaccaacccaaatgtccaaccatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccacatgttctcactcaggtgggaattgaacaatgagaacacatggacacaggaaggggaacatcacacaccggggaccgttgtggggtggggggagtggggaaggatagcattgggagatatacctaatgctaaacgacaagttaatgggtgcagcacaccaacatggcacatggatacatatgtaacaaacctgcacgttgtgtacatgtaccctaaaacttaaagtataattaaaaaaaaaaaaaaaagaaattgaaaatctctgccacagggaaaaaaaaaaaggaaaaagtaaagaaaatggggccacagacaagctttaagtgagaagggtgcctgaaaacagtgctaataaacactagattaacagcactagtcacttagagagctaaagcataacctgactttaatgcggccagtacatagcacatattatttgtttctttcattttcttcaaccagaccactgaggaaaaggctacaatgagtgcaggaacatttgaggacctgaaacactcttttcccattaaagaaaatatttcatctgggccaaaagcaattgcaacaaaagcaaaacttgacaaatgggacctaattaaattaaagagcttctgcatagcaaaagaaactatcagcagagtgaacagaaaacctacaggatgggagaaaatatttctgaactatacatctaacgaagtctaatatccagaatccacaaggaacttaaacaaatgtacaagcaaaacacaaacaatcccattaaaaagtgggcaaaggacatgaaaagacacttttcaaaagaagatatacatgtggccagcaaatatatgaaaaaacgctcaatatcactaacaattagagaaatgcaaatcaaaactacaatgagatacaatcacacaccagtcagaatggctactgttaaaaagtaaaaaattaacagatgctggtgaggttgcatggaaaaggcaacgcttatacactgctggtgtgaatgtaaattagttcagccattgtggaaagcaatgtggagattactcgaagaacctaaaacagaactaccatttcgacccagcaatcccactactgggtatatatccaaatgaatataaattattctaccataaagacacatgcatgcatatgttcactgcagcagtattcacaatagcaaagacatgaaatcactaattgcccatcaatgacagagtggataaataaaatgtagtacatatataccatggaatactatgaagccataaaaaagaactagatcatgtccttggcaggaacgtggatggaaccggaggccatttccttaggaaactaacacaggaacaggaaacaaaataccacatgttctcacttataagtgggagctaaataatgagaacacatagatggaaagaggggaacaacacacattagggcctacttgagggaggaggttaggaggagggagaagttcagaaaaaaaatctgtcaggtactatgctcagttactcaagtcattaaacaatctgtacacaaacccccaaaccatgagtttacctatgtaacaaacctgcacgtgtacccctgaagctaaagtaaaagttaaaatttaaattaaagaaaaagaaaatatttcatatggatattcattcgggactctttcaccaactttgcatcacagatctgaaagtggggagtacaaaattacattttataaagtaggaaggcaggttatagatgccagctgcgcttctcagggcatgcaaaatgacttttaccaaatttaaagaagaaaaactaagcaaatgaaattttttaatctttccatttcagtgaccaatggtgagactcttaaacgtttggattccttttgaacaacaacaacaaaattatatttggattccaagtgcctcattcaaatgggctttcatgaaaaagcaaaatgacagggcctaaatgtaaataccactaaagccccaggaagctgaaaagaaaaacaaccagtagggaaaacgtgttctctgtggtcagaagcagcaatgattcccagcgattccatgctcggcttttcttaaaataacaaaccatctaaagagagaaggcaagtgtgttctgctgccgtggtgatgggaaaaacctcagccagcagcgatgggaactgactagtcagacttggcagacacaagccccgggaacaaagtcaacagcatgcttcatgttttagggaggcttgtctactgtgcatcttcagaaaaaagatttagaccgagaaattcatggccacggccagaggttgatagtaaaaaggtagctagtctaaaaacactcagccctaataccaaatcgtccttcacatacgtttccaaaacctattttctatttatttcttttctattaaattttatgggtggtggtgaggtgagagagtagtaaaaacaggctggtggtggcaaaaattgccattctgtgctaccactctgggcagaatctcaaaagctgaaagtcatgccaggctcaggatcatcaaatagaaaccctgcatccagcctcatccatgtcaaccaggacttcaagggaaggcctcttcttacatatttccatgtttagaaactgcacacacattccatgttcacttactctaaggggtcaagaagttccttgtgatatatgattaatatgcattctcttcattcatttgactcagaagtctaacctaatctgtgcaaaatagttactgaaagattagaaactattgaatttcgttctttgttgttttgagttttcttacttttttaccactagtagtaccaattccagaccacaagtgatttgtgaaattcagccttcattttcaaaactgcgtataagcctatttatcctggaaaaagaactgacagttgactaaatgaaagaatcagcacaatcatcccaaatcttgagtataaacatctcctgtcaatggtctgggatggttctcaaagtggtttggggacctctgaggatctctgagaccctttcaggggtccatgaggtcaagacatctttataataatactataatgttataagactttttcattctcattcttcacaattgtacagtgaaattttccagaggctatgtgccacgagatgacgttatcactctgcagctaatgaaatgtttatatattcttgtacttgaaaaatctatcactggaagaatcgatattgttaaattggccatcctatcccaagcaatttacagattaaatgctatttctattgaactaccaatgacattattcacagaattagaaaaaactattataaaattcatatggaaccaaaaaagagcctgagtagtgaaaacaatcctaggaaaaagaagcaagcaagaagcatcacattaccagacttcaaactatactacagtgctatagtaaccaaaacagcatggtactagtacaaaaacagacatatagatgaatgaaacagaacagagaacccagaaataaagacacacgcctacaaccacctgatctttgacgaagctgacaaaaacaagcaatggggaaaggattccctatacaataaatggtgctgagataactggttagccatcctgcaccccttccttacaccacacacaaaaatcaactcaaaaatgcatcaaaaatttcaatgtaaaacttaaaactataaaaatccttgaagaaaacccaggaaataccattctagacataggccctggcaaagattttatgacaaagatgccaaaagcaattcaaacaaaaccaaaaattaacaaataggacctaattaaatcaaagagcttctgcacagcagaagaaactttcaagaaagcaaacaacttatggaatgggacaaaatatttgcaaactatgcatctcacaaaggcctaatatccagactccatagggagcttaattgaacaagcaaaaaacaaacaccaccacttaaaagtgggcaaaggacatgaacacttttcaaaagaagacatacatgcatccaacaagcatatgaaaaaatgctcaacatcactaatcattagagaaatgcaaaccaaaaccacaatgaaataccatctcacaccagttagaatggttattaaaaagtcaaaaaacaacagatgctgacaaggctgtaaagaaaagggaatgcttatacactgctggtggaaatgtaaattcattttgccactatggaaagcagttcggtgatttctcaaagcacttaaaaacagaactaccattttgaaccagcaatcccattacagcatatatacccaaaggaatataaatcattctaccataaagacacatgcacatgttatgatcactgtagcactattcacagtaacagaaacatggaatcaacctaaatgcccatcattggtagactggaaaaaaaaaatgtggtacatatacaccatggaatactatgcatccatgagaaagaatgagaccatgtcttttgcagcaacatggatggagctggaggtcatcatcccaagtaaaataacacaggaaaagacagccaaatactgtatattctcacttaataagtgagagctaaacattgagtacacctggacacaaagaagggaacaacagacaacagggcctactggaaagtggaggatgggaggagggtgaggatcaaacaactatctatcatgtactatgcttaccatctgggtgaacaaataatatgtacaccaaacccctgaagcatgcaatttatctgtagaacaaacttgcacgtgcacccctgaaccaaaatcaaagtttaaaaaaatgcttcattatatttaataaactcccaattactgatcttacaataaacattggtagatataactaacataaacaaaagcttcttgaagtcctcagtaacttttaagaatgtaaagggtttctgagactaatagtttgtaaagggtgggggttttatgaagagagacctttcattcaaaatattactaaataataactttgcaatgtggtgtcacacaagcagctgggtgtctaaaaactaaaaaacttaaacatccttaaactatttttcttgaagtccagctttcaccagtagcccagacttttcctttctctggatttttgcttcctagttgtcctcttggggagaaaaactttatctcattcaccatctgctattcttcctctctgcttttgcaaagaaatcctttttctgaaatcccatcatcacagccactcactggagctcttaatcacacacttccttacctattacttaacttcttcccatgttagttaccacctttacttctttactcatttttcattattatttataacatacctacttttttaaaaaattgaaatgatccatgataaaagacacatgctactgcctctttggtaatacctcccatagctctctgcctggcaaactatatgactcacagttgaagctatggacttgtctggactgcatcttctccctccacaaacagtgggactgggctcatactgaatctaatgcagcctcttatagagctgctgagccatcatttttgtttacaggattgcaacccaccaagattatgagatttacagtcacaattgtaaatcaaaatttacaattttaggggaaatttttctttctcctaaaactagcacagaaaagatgtttgataaccaaatcaattaatgaatgtagggctatagatttagaaattaaaatttaagagagataaaagggtaagcaaatgaacaaaacagcaaagctacaagatacttcatacagtacattaaatctcattttggccttcctgaaagttaacagagaaaagaaaataagagtttggattcatttgtttccctcccctcaatttcttttactttttgtatgaaaattttccaattctttttcctattctacacagttgttaagcaatctcttgttacatgttcatatttgatatttaaataaagcttttcttttcaagcattataatacaaagtctactagtccctcaccttacatgttgataagcagagttaaaaaacaaacaaacaaacaaaaagaaagctgatagcacactctttagaatggctgcaacaagcaaaaatatttactttttaattttctttcaggaatatatcaagcacttatgaaacatgtgcttcccagttaattcagatcatgttctgtttccccaaatgtgtatatcttgtcagctcaaacacaagtggcccctgaatctcaatctccactcaccgctcctactcattaaaattctggtgggatggtgagaatgtaataaaaagatatatgtgagctttatttgcaaatataaaagcatgtccccacagtatagcagagagagagagagaaaaaaaattcaattcagtagctttcccattcaaagtttgttaatagacgggaaagaaaattcaactcataatacatgatgagaacctttttcactgattaacattatacgaatagttttgcgcgaagtatttgtgtgggtaaatattagcatacaattattattcactcacttgctgatgacagcacactttccagaaacagctgggaaatgcagaaggaacaagctcacgagtaagcacctactgtgtgctaggaactccaagtatatttccatttaagctccctaaacatttgagaagtatgcatccatcacttgtagtacatagatgaagaaactgatgctcacggaaactaagtaacttgcttaagatgacacaaaagagggaagaaaaaccagaattcagatctgggtttgtctgattccagagcacacgctgatttttctacattgggttgccacctggaagtaatctcttagtattgagaaccttcccccagaaaacaagcatgtcacctgagcccaactaacccaaaagtattcaccatcattctccaaacacttttttcctggctttcccattattttaacaagttatgtgagtggaagaatagaacaaatcacatcctttctttacaaaggaatttagagaacaaaacccatcattaatatttccctctttcatcatcaactttcctgtaattcagataagcaaaaactcagccacctagatttttatagccgcattggcaagagtgtgaaggattccagcagcaaacatacacgcaaggtcaggaagtgccaaagccaccaagagtacatgtgacttcgggggttgggggcgggtgcgcctgcccacccaccacaaatcttagccatctgggctgtggagaaaaaaagggaggggagacattttgtggcattgctctgcacttcctcagctgtccctaacggcagctccagattaaaaaaaaaaaaaaaaaaaaaaaaaaaagggctagactggcatatctgattttaaaaatatgtccacaaatgaatatataataagtttaaaatatggggggactggaaggaaatacatcaaaagattaataaaagttatctctggatagtgagatgatccatttgcgagctctgtgtttttctaattcttccaaaattatcagaaaaatattatttttatatgaaaatagttctatgtaactatatgtagtatattattttaaatatttccgttttcaaacttaaaaaaaacagttgcatctagagggtggtagcctgactatttagaataactgccctccgttaggtctcagataattgaagtaatactcaggttttaacgactacccacacaaaccactttggatgtgcccaaattgccttgttcttggtgggtatccaatgggtcagaagatctatttaactgggtgctttgaattgtttgtgccagaagttttcttttagctggggtctctttcctgtttcatcatcaatttttaagttcctaaaatacatccagtaaatttaccagtttccttcatctatggtgctgaaacttaataaattgctcttttttcagctggaatgtcacgatgtccagtttattcattcatggccttacctgtgtgtctctgacaatattactactttggctttcacaagattcatattcctgaactatggcttatggctcaaatccagcagctctcacacagggcacctccttgagtattcatggcaattactgatgcttaaagatgaaagtcttggaccacagcgtgccatttaatgtacttctgaccttgcagatctgtgtgtgcttaacttctccacgtggatctcgcatcctcccagggtgctacgccgaataagagattatacatcaggggaatcactttgcagtcaccgagacagtgttttgaaaacgaaggaagaatgcaaatgtgtagaaactactgaagagattttaccagcaggtagtttataaactcaaaaccaggaatattgcctctaaggattgcagcttgaccaattttttaaagtgtatctttgttatttttttgtgatactctctaccaacatttagctttctttctttctttctttctttctttctttttttttaaatagctgggttacacatacctagaatcacagaacagtggatctggaagggaaattagggatcctcaacttcaacctgttcatgttaaagattaggaaagctgtggatgtgaggggtcaggtgatgtgatggaggcctcacagaatgagtggcagagagggccccagaaatagcttactctgttttcctatcatttgtaggtagcaaagtatataattaccacttttgtcattagacagttgttacataaaagagtagtcttgcaggtaaaaataattctaataagatattcacttacaattaaataattctaacagtgtgaaggttcacttatgatttttttaaaaattatcatgaaataacaaacatgtagccatgttgaggtgggagaaaaggggtccttacgtctaaacagcaagagaaaaaacacacaagaagagccaatctgtcaccacgagagctgcactgagtccttcaatcttgagaataaacatggatagaagttccctctgaaaatgcagttatagtgctaaatgaatgacttaaagacacatctttcctctttgttttgtgccatgatctgagtgccttgagaactagctttcatccgggcacggtatgacatcatctgataagtgtgatgctctatagtcgttgccggaatgggctagggtacaaaacagagaaacacacaggcaggaaggaaggcagagaccagcgctaatttaaacattctatcctgaatatttcagttgctccataaatgtttaatacttggtgccatattacaggatgttcataagcacgcagatatatagatgaaaagtaaaataacataagcaaaacaaagctcattctcaagaggtgaggatggctatgctttctgttgctggagtccctttacaaccacatctcttagtgcagctgaagacttccagcatcagagacgatttctggattatgagaacctctactttagccttatccctctatactcagagccacagtggcctatctggccttccccctctgcctatgaccctgagacctttgactggcacctctgagcagtggtctcaagaggacagccttgaaaatatgactcaatcctccatgacagcgagaccagaagatccatgtagagcctatggctgatccagaggttctccaagttgatgttgccatcccatttctgcctctctgtaatttgtctaaagactcactgtggtttcacggatatgatcttggatgtataaaatgggaagtagctgctaaaagatgagaaattcctggcctaagtcagttctagtaatttcattcactcattaattcgcttgttcattcaagagatagttcctgcatgcctgctgggtgagtgtggttacctgtcctccaaaacctcataatctactagggaaaacccacacaaacaataaataaataaataataaaacacaataaaacgatagagagttatgaggcttgaggggatcatttatagaggtggcactgtcctgaatctagagtgaggagaaggattcaggaggcagaagggaggtcaggccgcaccccatactcatgaatatctgattagtgtagctttcaagtatcactgaacatctttgtcctttgcaaacaaaaagcattttaatatcacaaattcctgagtgctagggaactcaatcaacaactgtaaaatgttctgaaaatataaaatgcaacacaagatctaaaagtcattagtaacaacaaccacaaaccccccctcctgctttatcctgaagtgagcctttcaaccagagggaaaaacacgaattgcctgaggaagcaggggtaggagatgtgaggactaagattctgctttgaaagcagaaagggaagagttgccaccattttaacatttagtgactagcttatttatatcccccttggccacagtgacaaaaacacagctttatttctaaagacaaccacacgggccattattcagccagccttctcaactgatgatgacgtgaactgtgaatccacattttttcctgttaatagacaactgaaatggaacaaatatcctgaactcaccctgatctcttaccactgaagagagcaaacacaatactctattcattctttcatccaaattcaatcattgacccacacattagtgcaccatggtgttgtgcattaaattagttctcatgaacttctctccagaagggtgtattagttgcccggagctgccataataaactaccacaaactgggcggcctaaaataacagaaatgcattctctcacagttctggaagtgaggagtctgaaatccaggtgtcaaggtgtcattgggagttggttctttctggaagttctgaagaagaaacagttccatgcctccttcctaacttcttgtggttaccaacatttcttgacattccctggcttacaaactcatccctcccatctctgctcccatcttcacgtggcattccccactgtgtctgtgtctgtcttttctcctcttcttattgaacaccagtcaaactggattaggacctactctaatcaagtatgatcccatcttaacttcattacatctgcagagaccctatttccaaataaagtcatattcacaggtactgggtattaggacttcctcatatattcggggagatacaaactcatgacacagggcatttcacagttgttttatactactgccttcttaaccaagaaagaggctctcactggcgtcaaggagtttacagcctagagacagagacccataaatctgtcttccccgctcttcccatagctgcagttttagctttgtgggtttggtgcttatcaccttatcacccatctctgccagaagactgtaagctcccagagcacaggcagcatccattttctgcttcccattacattcccatcttcttgcacagtacaagataaagctttcaagaaataatcgttgaatgaatgtatggatagatgagtgaattacctagatacaagcagaaatgagaaaagcctatacaggcaataaaggtacacacaataggccaacaaggaggaatagagagaaagaaataattgattctgattagtagggatatagaaggtttcatgaaagaggaggcatttgagctcagccttggaggatcggtaggattttataaatgaataaggagtaaaatttattccctgctgaccaaacagtatgagcaaaggcctgcagacataaagtatggtcttcgggagaacagttaatagcccaggcaagctggagcaaagagtatctaaagggatttaaaaacactttggatgaaaaggggaagaaaggcagctcacagaggcctataaactaggctattctgagtgcagtaagaagccactgagctttgtggagaagggaaatgatttgctcctacctgtgcttcaaaaggaaaaaatatataggaatggttcatacattgatcttttgtgtcctcctgcctgaatgatagttcttatattactataaggagtatttgcgtattttatatttacccatgcaactactatttacttgatttgcctaaggaactaagaactatatacaagcgattacattttataattacacaattatatgatatatatcatataaaatatataattatatgatatatatcatataaaatatataattatatgatatatatcatataaaatatataattatatgatatatatcatataaaatatataattatatatcttttataattaaaagatcgtatctgaaaagtacttaaataggataatatcacaggtcctaaatttcttctccagagaatgacctggagtttaaggcccaggggaagatgattaactaccaaagtaataacaaggactttcacctgtaacaaagcagttgttccgggtcaggccaggttctttggtttaggtttgagcatgggaagtccacagaccaagtatattaacaatcaaggtggtgcaagactaccatttgttgttctctccaggaagcaccagggactccatcactcatcacaggcatctggatagcagccaagcaccatgatagtgggatgtgggagagacactccagctatccatggaggactgctcaatggctgaaatgctgccaaatggagagacatgtactatggtcttggtgccaccaaaagtcttcggtaataatgcaactattcttaggaagaagtattcagtcactcatctgtaaagggattcattatatagaactgttaaccaagagaaacaactacctctttgcccgcttaggcaaatgggagactgggaatctggacagagcgtgagtgaacagaatgaagatgacaagaaagggaaagaaagctcttttcacccttacgaaccctataagttaggccccagactttctagtttacagtcatcactttgttatttaggttataagacaatagaggggttaggattgtgtttttctgttcacattggtatccaggtcctagcacgtagttgtatcagacaaatgtgtgcccaaaaggagtgagctgctaggcagcgtgttcctattccatggcactttgagtatgcttcttggaacttgagaatatattgaaattgtgcccatgtgtctacctttcccatgggacagtaaccatcctaaggaaaggaaacgtgtgtgcttattactactatagtgcttgacatttagaaagcatctaattcttaaagctcagggggctcaaataacttacatgaagttaaatagctcataaacaagaggcttagatttgtactaggtctgtctccaccccaaccctatgctgcttctatacctcagtgtagaaagaaggagagtcatactatatagtttagcctgaacctggcctatagattgaaatgtctctggaaacaggtttgctgctgctttccagccttctaaatcagacagttgcataattatttaacatgagtgtttcaattatttaatgcctgatcaaaacacaggcgtaacataatttaaacacaagccaaagcatatacaccacaaaaaaatactgagtccaagtaatcattttccaaaacatattaaggtttttatttactaatggtcttaaatttctgtttaaagagaataagcttggttggccctagaaaatcttggagaaattcaaagcaaaatttcttaagttaattcttattgtatacataatctagctcttataaggaaatattgtaaacctgtttaaacctatcctcctaaaacccctagacatgttcttactcataaaagacagtagaataaatcttcaaaacctaattattttaaaactgaatgcagttctttacatggtctatcgattttatccttttgccaagatatcaaaatttttttaattgaaaaaaagcaactttgaaaatgcactaggcttaaacctccttttataaactctcaaattaacacatcttagtttaagcactaatgaaacacatttcattccagtgggattccaaagattaacaatgtatcaacacatatcccaatgagtgcaaaagaaaatttatcctagacttagtattaaaaattacatgccggccagcatggtggctcatacctgtaatcccagtgctttgagaggctaaggtgggaggatcacttgaggccaggagttcaaaaccagcctggtcaaaatagcaagaccctgtctacataaaacttaaaatacataaataaaaaaaatgtagctgggaaagatgattgcacctatagtcctatttacttgggacgctaaaatgggaagatttctggagcccgggatttcgaagctgccgtgagctttgatcctgctactgtactctagcctgggtgacagaggaagactctgtctcaaaataaaatataaaataaaatttaaaattacatgcaaaaacaccagaaatgaaattctatcttgagaaacgctttatcctttgtactttagattttttccagaatgggcaactttccatagttttatagaaaatgtttatattgttgggcaaaaattctgcagttaagttctaaccacagtctggaaggaatttagcatgaagacaagttaaaattacaaagagtgtttttccccttactgataaattaacaagtttaactactacggctaataaaacatgccttaaccatccttccttggtattttttaatagctttgggaagatttgggggaaaaaaaaagagtttcagagcaacatattcattgaggttagcaggttggctaggaggttagttgaccgggtaactggctgacccgacagacaaattttaaacatttattttgcataattgaagcaataaaatggatttatgagcagttgattagagaatcaagtttgttaaaattcctttatagccttacgtttctcaaggcattcaaccaaaaggaacgagacctttttaaggtaccagaaattaagaaggaaaatgccctgaagagactgaggtattctccaaaaggtcataaccttgttgtatatcaaatcattctaatagatattccaatgttgccttccagaagcattcatctgagaagacaggatgtcttaagtacctccttacaggaagggtcagtctctaaacactgaaatttagagcatcagccctcacccaatcttggaggttagctaaaagcatcttgaaggatgaccccgaaagcgtaggagaggagagtttaatctgtggctattcaatatgcacctgactgctcatgcctgcaaaataacccatttctggagaaagttgtatagcctcttccatttgctctcttataattgatcaagccagaggaaagggggtcctccatggttcttctggacccttccacgttggcctattatatttcagcagtttacctcttctttaattagcaggcatagctcaaagaacatagacattttgatttaaattttctaatttagtacccatgatgatattctaatgtgtcttgccctctgcctataaattgactaataaaattaaataaattgttactaggggcttcactaaaatggtctacaaataaaagattacatccagaagataaaaagaaaatacacaggaaaatgacccaggaaaaaagctgacctggtctgtcaatttgctcaggttgaaaatatgtggaaagaaatgtaattgtgttttatgacacttaaagggaaaaagtacttctgatttcagtactatctagaggataaagtcactacttgattctttgtttctccaaggtaagagtttcccatcatcaagatgtctttctcaaatacatgatttatggaaaaaaacaaaaaatgttcaatgagcatctatggattttgattcagaaacaaacaaacttgctaaatggtcttctaacaaaatactaataatcccatgtgggcatacttcacgcagagtaatgccatttggccctcatatttcttagaaagcttttgctgcattcacatgactttccaaaagataggcaagcaaagagcactgtaaagaggctgtgtctgagagaaaacacatagttggctattaatagtcccactcctgctggcttgcctaaacacaggactggctgtatttccccatcccagcatagaggaacaatgttaccctgccaatcaaatgcagcatactccaaccttaggcctttgcaacgaagcagggtgtcgggtggaagaccagtagctcagaggctgtgacatctgtaactaggataactccaattaaaagtagggggaaaaaataatttttaaaaccttatatagtaatgaactggaaggacggagaacaacgatttctttagcaacagctgtgcagactgatttctttgaaaatcatgcatatactttcaaaagcactcaatcacaactgctgccctaacactggcaaatccaagaaattcaagacatgtaatcaaaaatagattttcccttaaattccaaggtcaaaggcagcatctgttgtttcagagaacaagaaggactttcttttggctaattaacttattgcggttttctagcagaaaaaaaaaagtaaaccaaaattgtctaaatgtttcttcatcgtcttaggtcttaggtaatgcaaaacagaaaactgtataaagagcataaacatccattgttttgatatttgagttgcacagataaaaggcaggccacgctgtaatttttaaagctgacaggaaaattcatttttataccaagtccccctcatgccatttggctgttaaattattcaaggaattctctgcttataaagattaataatatcaacccaagccatttctgaaaagtactttcacctcgtgtaggagacagatggactacaggaaaacagcctattatgttacaggcagacaaaaagatttcagattaccagattaacacaccaggcgggaagggaatgatagaaagtagcgagatatgaaataactgacaaatagaaccaaatatccctcagagccactattttaaaaataaatatagtttggagcccattgtaattcaattttacctgtttcactcccaaacccagctaattagcataaatgtcagttccaatttaaccaaagactttgaaaatctggtggaaccttattaaaacacattggtatcaggggacaaagacagcacctgctttcaaggtcttttgtgttttagtcagaaatgtattctaaaactctgggtatatgggctgaatccagagtttagattgtgggattttattgtacatttgcattattttaaatatcaacatccctggagaagctatttttactcctacaaaacctaaacacttccttatttagcaatgctctcatagagaagggattttccaaaagctgtatttcactaagggtcaatatgaaaaaattacaatgtcattaaaatcacagattttttgtagattcacagaagcaggctcagtgttttctttcaataaatatcttttttttagttcaatacattactaattaattttaatttcacaaatagtgaaattatctgagcaagaatcattctcatttaaaattgtcaaataagtcagaaaaagatcaatatctcccctgcttcaaaaatgacactcccaattttcacaggtaaccactgttaacatttagtaaatacctttcagaaccttttacaagcatatataaagtacatcatttttgtagtataatgtgttttctttaaaaaaataactgggaccatactgtattttctacaatttcctttgatcattccaaattgctatgaaaatatgtcacacgtaacttgaaaacttggtctacttctaccatatacgcacatatgcaggtaggcaaacatacagaaaaacacaaaatggtgtaaaaataagccactaagaaaaggctctatgtccctcatttcagtgctcaggaaagctataaggctgataaaatgaaagtgccccctttcctcaccaaagctttggctttgttattagtgttttttttgttgttgttattattgttgttttcttttctttttttttttttttttaagtgcaaggttgtgaaactctgccaagtggttcaaatcagatccactacctgcttttgtatagccagtgagttaagaatttttttacactggtaagtgtttggggagaaaacgttttaaaagaacagaatttcatgatatgggaaagttgtatgaaatttacattttggtgtccataaatgaagtttaattggaacacagccattctcattcctttgtgtattgtctgtggcagcttttgtgctacaagagcggtagttgattagttgtgacaaagaccgtatttctagaaagattgaaatatctactctctaggcccttatcaaaaatgtttgccaatatctgttttagcacatgaaatttattttcctaacatcttacttgcaaagtctttcttcatattccatgttgacactcagtgggtaaagatgacagaagtatgctggggggcaggagtagaaaatggtcccttcacataacccaacacataggtaacttacgtatgcccctcctagaccttcagaaaactctatcaggcttaaaaattacttgtaatgtattgccataagagtgatttgtggattacaccgcatggattacgttgccctagaatctaattcattcatctatctggtgagcacctactgtgtccgaggtcagtgttgggcactgacaatttcggggtcaagaaaatggacatcatctctgccctccagaactcccaccccaatatgttcattacaatttcgcgaacctatgaaagtacatatcaggggaactaaacacagtctgaagggtggatgagattagagaagatctgaagtaatttcagtatcatcagattgaaaattctttaaaaataaacagtgtgaagatactgcacaggaatccaagtgagaatgacagaaactgacaccacctgactgtctctgtcttcaaactctgctcttcataagctatgatctagagcaaagggagcattttagcctctgattaagatggtatctccttccagttaatgtcaaatggttagtgcttggtaccatcaatagattgagagtttaaatttgattttcttagtgtttctaatccaactattatacccaaaacccctccacagaaaacagaaatgaaactgccaatccctacagtagctccagtaaatatccattggcattttaaaaaacaaaacgaaaacaccctgcccatgctgcaatgtaatcccagtagctactggcagtgacagctggtcattcccaagcagaacgtcacccaaataaaatgtgaaagagaggagggaggaagggcaaaaccaagatttcagcaatattctgcaatccaggaacctatggagcatttgggtaaagctctagtaacttcaaggctctgtgcttttaaggcttgaattcttttgagtaactgaactctgtgaggacatttaaattgggtcagagtctctcactcttacaggcttccttggtatccgatgttcctgttgacttcatagagaactaaacaagcataaaaggtctctagagagaagcagcaactggaatctaggacagaaagaacaaaatgactttacatggctgctactaggtttctgttattttcatacaaatggctgagtgagccctgttgtatctgacactatctgcactggtttctcattagaacctgagctggcgagggtcaggtgttcttgttcatctaattgttggtaattagatgggccacccttacctacacaaagaactctgagaactaaaaaggttctattattcaccaaatacaaaaaaccatagaagaggactgcaggtagctaagctttcgaaaatgtcagttttgttgttattgttgttgttttttacccacacatatccaaatatcatctagctccaaaaggaaagatttacgtagtcgtcagaaagagaccagtttgttaaagagaagaactcagggccgggcgcggtggctcacgcctgtaatcccagcactttgagaggccaaggcgggcggatcacgaggtcaggagatcgagaccatcctggctaacatggtgaaaccccgtctctactaaaaaaaatacaaacaattagctgggtatgctggcgggtgcctgtagtcccagctactcgggaggctgaggcaggagaatggcgtgaatccaggaggcggagcttgcaatgagctgagatggcgccactgcacttcagcctgggcaacagagccagactgtctcaaaataaataaataaataaataaataaaacaaaagagaagaactcagattggctggtgctgtttctaacaggaaagcctttctctctgcaaacaggacagagaccaggaagacaaacaccaacagaggagaaaggagaggacatccaaaagtggagtggcaattataaagtaatgatggttttataaacagagaccaaaggcaaaatgcctttgctgactagtggctacgtctagggattaagaagctctggacatctgagtagcctccaaatatccctttgccatagtcacatgagttgtggctaataagaactaattaacaagtaaaacttcaggaaacacaattaaattttagataaagttagtatgtcctgtaactattatgtaatatggaacatacttataatgagtataattatctgttatctgaaattcaaatgttcattcttaattctaaattcaacttaataaaatattacatacttttagttatggaacacacttatccttaaatgttattgtttatctgaaatttaaatttcattgagggtgttgtattttatctggcaactttaattgtggccagtacaaacagccaaggtcagtaaactatcaagaatttcggggagccgataacagttttctgatatgccagaggaccactctggaaagggtttatttggggatttgattcattaattgatgtttgcacaagggctaggaggtacatagtactcgggggaacctgcttctacctcttgaatgaaaaagagacaaactttgctgacatcagggacttttgtcagaaaacaagtcccagagcccttgcagaattgtgcccactcttctcgagcctcatctgctctatccagaattcataacaactgaggtccataatgatgcccttgggtcttcgtgggttcaaatttgtttagaagtgttcactaagacagcatgttatgtggcagggaagaggagaattggaaatgtttccaatatcaagattatatatttcaagcccctaaaaattaccccacccagaaccttgaatagaaaaagaggaaagttaccaaaagtgatcagtaaaaccaagaggaaaactacaaaggcattgaatcaaccattggttttaaatgtttttaaaatttgttagtgtatttctttggctttattatgtagtatatacaaaaataattgttaatctttgaattgcctttatctttcaagatactgattctcgttacagagtattatagacagacacacaaaagcagcagccatttaacctaaaacgacagaagcgtatataacaagtgtcctgaaaggcttatgtgcatttccttctcccacaagaaaaaaaaagaaaaaaactcccactgaggttccctaattacttagattttgataaaatgataatcagcaggtaaaatctatcccagtgattctcaaacattggtatgcatcagaatcacctggtgggctgcaaagttttatctaaaatttaaatctaacagtttgtcctgaaacatagattgctgcaccagaatttctaaatctgtaggtctgggatacagcctaacaattcacttaaaaaaaaaattccagataatgcaaatgcttctagtctggaaatcatcctttgagaaacaccagtctgtgcaattataggtaataatattgtttaatttatttgttcacattgagtatttaggatttgtgctaccataggagcaaactacctctgcccttgagggtgctcttcttaggattcatacctagtctgcttatatttttagactgtccagaaagtccccaactcacaagcaccatacttagaatcatctactcctacaggatgcctaccctactctgcccctgaaaacccctgctgccaataatgcaagaagcattgtaaaactgttaaatttttagagaatctatggtaaagaaaagacaaaagctaagctatccctgggatgagactcctactttaagataaaaatgatttctgggacaattagggggtctgttatgcaattatacctcagtgtgacttagttcaaccaaactggttcttcctcatgctaagctgaaccagggttgcagagaggtaaatgatcctgagtatgaagtggcttgtagtatcaggcagactcaagtggaaaaacactggtgacctgcaaaaaattgcatcaggcagtgcactatgggttacaattgtagagccaatgccatgtgggtgttcaccaactatttctcttgcctcctgagcacacaggagagctacctttcccggtcccctcatgtctaggagggaccaagggactggttctacccaatagcctatgggctggagggctggacagtgctatgcctggccgctaaaacaccccacaaagatggatacgctctctcttcagctgactctggaggcaactctgaggaggccctaggggacacagtgtgactggacaaaagttaccaggatgcccgtggcattgcctggaggaaagctgctcatccagaacagtagctctggagtctgcaggagaaagccacagaccacaaaatattaaaccactgagttttggtgggcggggtgggagcaaaggggggtgtgtaatgtgttaccgcagcatagcctagccttcctcaactaatatagctgcataaaggaaggtgtaacgggtgccccttcatcatcttagccagaccaaactgttgctccactccattgttctatattacatagagccaatatcaactttataccagatctgtggctcccaaacctggctcataaaaaaaaaaaaaaaaaaaaaaaaaaaaaaatcacttgtttggaaaaagaaccctgaaccctatttcagacctactgaatcagaatctccaagactcaggccaggccacttcttagacaaactgcatgttataaactaaatgtctgtgtctgcaccccaaaattcttacattgaaatcctaattcccaacctgttggtattaggagatgcggcctttgggagatgattaggtcacaaaggctctgccctcataggattagtgcacttataaaataggtcccagagaagccattacccttgtgaggacacagtgagaagactatgaatcggatcatctatgaaccaggaggcagacccttaccagacactgaatctgctggaggcttgatcttggactcaccaggctccagacctgtggcaagtaagggtttgttattcaaaccacccagttcatgatatttttgttgcagcagcccagatgactgggacactgcagattcgcctgcgtggggctaccatgaaaagtccctttcaaaggaccagtttgcccctatccagagactgggtgatatttctgcagacacacagtttaggttattgtggtaggtttactaatccttaccaaattattttaaagtgaggattttaaattatgttttggcaggaatcaaatattcaagtgtaatgggtttaataaatttaaaagcttctcttttaagatgacgcaataattggcataaagccgaatgcctgaaatacctaccagtgagaaggatttaaatgttcaattaaaatgatttgagatttattgcttgtgaggaagatatttaaatatgtaaatgaaactggctccccaccctctccagtgtgggggtggattctgcctgcctttcctcatgccctctaagggagtctctctgccccttgaggacaaaggcattcaaatgacagagctggtggctgtggcaggaagtcactaaggaaacaatggagggcgctgtggagatggccacttccttcttcctcaaacacagcaaccccacccacctcagggcctttgtacttgttatttctgtaatcttcatccagatgtctgagagacctgctcctgcactttccttatgaaatttctgctcaaatttcatactattcttgatgccttctctgaagcaagaatcccttgctatatacacacacacacatacacacactccttacaccctattttatttttctctgtagtagcttcactatctgacacgttaactattacttatttgtgtatttgctgtttcctatactcgttcataatgcctggtccctactaagtgctcaaataaatgttattatcattttaaaaaattatttaataccatggtaagtatttttcattgtctcatgaggcaattaagatttggcaatattacttcagtttaattatttcccactaatatatatcaaaaatatatatttttaaatcaaaagaatgtaattgaaaacagcagggcctccagatagagaaatgtgtccaaactgcagatcttttctaatgagctgtgtgtccttgggtcatttaccttaaactctgtgagcttcagttccctcacatataaaatgagcataaaaattccagctttcagggttgttgtgaaaatgatacatgaaaaaattaaatccctaagcacatagtgtgccccactgatattctaaagaagtagatggcaaaataaggaaaataagagaataaatgcctttttatttatgccagtcattagctaacaatcaaccactgtgaatgaaaaaagcctagtaaagtcaataaaatgtgaagtgaagcctaattcatttttacaatatgacctactttctgctatttttgattcacatgaacaactgaagttgcaaggagctgatcctgcaaagacttcattaaaagcatattcttttcttttctttatggcttccagctttgagggatgcgaaaacagatttttcacttacaagcctcctttgaaagaaccctggcactaatcttacagtacgactttgaaaatctgtgcaatgtcaaaggttgtcacagatgggggaaaggagggaggacctgaaggaaagcggtttttaattctactcaattatgcaacttccattaggcagttctgactgtcctaaatagattattcagatcttaacatttgaaggtttgcaaaaataaaattctgaatgatcttcttccttcgatagacctaggtataggctctgtggagaaggcctagctgtgctggtttttcatctgggaaatgcgcttattagatactgaccccaaatcagtcaagtgtcattgagtcttagacagcaaaatagctgaaagaaaaaaaatattttcggctgctttggaatacctttgtaaaggccattgtcttttctttcatggactacagtattctttaaccaacttaatctacctgctaacaaagatagaagaaggaaggcttattttcccataaggctaaacaaagattaatgatagccaaccaaattgtctcttaattttcttttcttctccctctccagctggccttctagagatagagtgtatagatttttctcttagttaagaacatttacttagaaagcagcagaatactaataacaaaagagtagggggttgttttgccctacacatcacaggaattctgccttgtaagctggaggaggtataggggcattttattgttgggggattcttaaccaggcagatggggaacctagcggccaaaaaccttcttgggtgaatcttacatatgatccttctgttcccactatatcctccaaacccaaccccaatgagaaccactactctgcccttcagaccctgacctacctttcgaattatgattgtagcaaaccaatttgtcatgccatgttaatctattcttaccctacgaccccgaattaaaacactcccaggggccccacccaaagaagagtaaatgccaagtgagtggatggaacaggtccgtttgacctcatttcaaaatataggggaaaaagacatggatggtcctcccacaaaataacaccaccacgagttatagaggtgcccatttcgcttctgtgacaaaattttcaaattgaacaatctaagcctttgaaatcctcacatgaaaacaagattttgtgatgctctgaaacagcagcacatgttctgatcccttgctgggtgggaagcactgggggtggttaatgagttctcacaccctctggtgaaccagctcctttcatttctgagtgaagaaaggggccctgacagtgcgctactccataaattcaaaaacaggccactttctaccccagatccacagccactccctggccctttcctaaagggttcccaattaggaatatggcaaagagagccctgtaaataccagttgctgtcatttcttaatattttctgtgatggcttgacttgctaaaatgacaaggtgtattatttttagcttccagttttggcgagttgatcagtcaaaacaaagtattaaaatagcatctacttggtaaattcaatttcagatgactgcatctaaaactcatatccattatagactcatataaaactgacttatatggctaaggaagtctgagaaggaataactaaatatatagctcaaggaggaaagatgaataacttctttggtctcaaatacaagtctattttggcatcaaatccaaaagcaagcctatgataagcaatggattcatttaaatcactttaggacaaatgatttaaagagggttttctaacgctccagtgttccatccaggatgtgtgaaatgcatgagatctcagttaaatgtagcatttttaataaatatagtctaagtcacacgggcctttttgataatgtaatttttttctttgaacgcctcttttacaatatacctaaatgactatgaaaagctatctcgtgataatatatgctagaaaaccccattttatattatttttaaagtaacttattctaatttttaaaagtaataaaagtgtaggggaatctggataggtaactgcaactcactactatctttgcaacttttgtatttaatttaatgtaaattaatctaaaattaaaagttatttttttaaaaagcaatatttgtttttactgtagactatttggaaaagtatagagaagacggaaaatcacctataaaaataggcatacctatatctaactgtgtgtatatgagtaatacatcctatcatcttttgattatatggtatttcccctaccattaaaaattcttcataaactttgttttaaaaggccacttatcattacatcatatagctagcccaaaatttgtttaatcattttcctacgtggaacatttaacttgtttactgtttttggctattggaattagttttacaaacaatataattgtgcataaagccttttcatatttctcattatttcctcagagatggatgaacatttttaggcatagccaaacttctttccagaaaattagccttttcttaaagagcatgcatcacccaacctcagctcgcagtgccaccatttatgacaaccttccaaaatggccggaacgctgccagcttcacacaccacggcacttcctgggaagaacctcaggacagaatatctgctgttgagtcagggctgctatagccagagaaaggtgtgagatgtgtaactgtctccaggtaatccttctgccagccaactacctcctgattcagctataacctgaaggccaggtgcattcacccaaacaaaacccacagaaatcagaggaagggtgactgaggataagaaaggctagacacataaaagaatgatgtgaaatttagcttttaccaagaactgaagtgttatatttggccggagattattcccagcaaaggaaacacaaagatgcttgggtattatctatactaaaactgggaaaacctcagctgaccctataagttacttgaaaatttggggacatttttgtcagaacgacagaaaagcaatattggatgggactagggggtggaaatgctagaaatctgtgatatacagtgagtgccacaaaaagaaaaattattttgccccaaatgccaaaagcacagtgatgttctttgatgttacagccacaactcttagggaagaggccccagttgatggccttcgaactatattctgcttgaaaatattttgtttgatcctaatagttggtgttgggggtgggagggagtgtgtgtgtgtgtctctttttaattttaaatatgaatattttggaacttttacataaagtctagcttttctaaaaaaaagaagaagaatctaagatctgacaacaggccgggcgcagtggttcacacctataatcccagcactttggtaggctgaggtgggcagatcacctgaggttaggagttcaagaccagcctggccaacatgatgaaaccccgtctctactaaaaagtacaaaaattagccggacgtggtggcagccacctgtaatcccagctactcaggaggctgaggcagaagaatcgcttgaacctgggaggcagaggttgcagggaggcagaggttgcagcgagccaagatcgcaccactgcactccaacctgggcgaaacagagactcagatgtctcaaaaagaaagaaaaaaaaaaaaaaaaaaaacctacaacactggatccccattcccacggcaataattggaaaatgaggagtggctgtcccctttgggctgagcaaactggccatttcactcatgagaattacatgcctggccctctggccatcagtttgcaacccctatcctactacaaggtctttcaaagattttagcaaggccccagatagtaacctttccctttccccatcgtgctcagcactcagttactcgacagatacagcacagggagcgcctcccgccaaaggcagtttttttctccaactgcgtatttgtcttttaatcatcatttcctttccttccctggccaaccacactggacaacccaggagcctgttccaggagctgagagcaagtcttcaagtaccagtgccttgtttcttcaccagctctcccaccactgttatcatcacccctcctaaaccacctcccaccaacaaaagtatctgactgaggggtgggaagtgtcaagtacagcactggacagtgggtggggctgatcacaatgactgtgcaccagacaccagggtgcttgtcctagaacaaattaaaatggaaagaagggttttaagaactggaagaataatgtgagatttggcttttaggaaaatcacccaagtagcctgcctgtttgcccttgctctctctcgctctctcctctctgttcacacacacatacacaatcctctgcactgtgaccgtagaaactggaaggcgccttcctgaggatatggagtgagtggaacagaatgttggaaaagatgcctgggagatggaggagaatgacagagaagagagggcagcacagaaagcatcttccgggaggactggtggccatcagagacctgcgaggacctagagctgattcatggccacattagggcatccagcaatggcttgccctgccaggctctcaaaaacctggcactcaggagcagcatggaggagccttctaaaaatagtctagaatcaagctaccttctggctcattccgttttccttcttttaaagattaactaacctcaggctgtgccaaaaaagactagagggggagaaaaaagactcatgaagtcttgaacaggtgctactgtttattcacccaagtctgacatcaccacattgtttctagggactacagcaagtttctgggcttcaaacactccagtaatttccttagggaaaagcagagtatgaaaggaaggtagcttgtattaaatttaaaaacttgaatcctgtatagttgatctttataagtttcttttttttttttttaccataaactgtgccaatccctttgatgacagaatctattattctactagcgcttacaacagatcactgtcatttgaagtgactttcagagtcttcagagatacaaataaacaatgcacccttccttccccaactgccaaaaaaaaaaaaaaaaaattgtctcctcctgaaaaccaatcactagcaaccttctattagcttggagaatctttttaatgcaaaagggtctggaactaaaagtgatcagggcaaggatctcattttattcatatttctatccccagggataagcacagtgcctggtagactgtttgcgtgcaagaaaattttgttgaaaggctggacaaataaaagaaaatgcataggttgtttattaatttagtaatgcaatttccaaattttgttttttcttgttgaggtataatctatgttaaaattcacccatcttaaatgtacagtttgatgaattttaacaaatgtatacagtcacataaccaccacaattaatcctaaaaagttctctcatgcccctttgtagtcacatcacctccccataatcctagttcattgatctgttctccatccctatagttttgccttttctgaaatgtgatattaatgggatcacagtacacagccttttgaggctggcttctttcacttagcataacaattttgggattcattcatgctgttgcatgtatcagtagctcattcatttttattgtttagtcgtattctgctatatggatgtggcaagatttgtttttccattttccatttgataagtatgtagatcatttcccacttttggctattatgactaaagctcctatgaccattcaatacagatcttggtactggcgtgtgttttatttctcctgggtaaatacctgcaagtagatttgccaggtcatctggtaggtgtataaataaccataagaaactatgaaagtgctttctaaagtggcactttagaatgtatcattttacattcctatcagcaaggtatgaaagttccggttgcttcataacattggcaacaattgatattgtcagtctttttaactttagtcatacagtgcgtagtgtatctcgttgcaattttaatttgcatttgcctgatgaccgatgttaagtatctttacatattcatacagcccctttacaggccaatcagatagcttctttggtgaactgagtatctagtaatggaaataaaatctacattactcatttaaatttctccaacatattttgactgatatccgttaataaccttgtcaaaactaacaaaatgggtttttgttttcctccattttccacggcaaatttcctaagatgaattacacacttcctttactccttaaagttaaccattttcacactaacttaaggccttttgttccaaatatccttgatactgtgctgtaacaactgagcacactcttaacctcctatcagttgactgtgtgcctttcttttaaaaattaggtctgtgtttcattttcagtgtttttgtctccctcctctctctcagggtctactatatgctgttatctctgtgccactgtaacctgctgtatgaccacataagtcaagcttctgtgacaattttttaaaaataagcataaacagctctgaggaaaggcctaacagtctaagaacaaagaccatagtcccctcggagggacctgatgacatacattttatggcttatttccagatcatggctctgcttgagaggtaggcaaagtccattaataagtgtccttgggatcagtgagaaaaatctccatcagcatttccaggtgcactagaaagttttgtgggtacttaccaaccaacagtgatagatccctgaaggggccagtttttccagttccaattgtgataccaaataaatatcatgtttaaggtcagcaaagtgaggtagaagtagggttactgctctaatgcagtgctctaaagtaagacctcaactttcctttttgttcattttaacagcacagccctttggcagggagcttcatgctccctggaatcctagtggggatgagaaacacaagagctcctttccctgtggaagcctctggattctgacacagcttcacctcttccccacagcctcacctctctaagccagtttcatgactataaaatgaggataatgaagtacctactgcccaccccagagcactttgtgccaaccaaacatgaaagagaacgtaaaagtgtgctgtgcactaacaggactccaggagatcagcattatcacagctcaaaggcaagcctggccaccaggcatccatggcaatctcatgccaggcaggaagttcctatgaagaaaaacaaagacacgaataccccttagctggaaggagagaaggtaagagcctccaagtgagaatggagtgatagtctgtgcttcctggacagaggaagtcgcaagaggaacggaaagcaggttttgaacagggagaaagcaaaagacctcagataagcaaagatgaggaagggacatgaggtccaaacgttgaataaagaaacagtaatactgggcactgtgggacgcctttgcatgtaaatacggtttaagcctgggcatcctatttgggcggatatagttacaatgccatatttcattcttgaggttggtcagcaagactttccatgaaacttctgctcccttattcccacttactgttccttatccataacgatagatgtgtattacatatacttcttacctgctgactggatcttctgtgatcacacctttcctaatagaatatttatccaggcctgagttccatagtcaaagaaggtagaagataatctgcttaaatgaagtgcctggccatttcattcacttctagaaatattttctcaagattaccatgcaagcaacagattttcaggaggcagaaaagatttctagactttgcccagagggagaactacaaatgccctcaggataaatagtgctccaatgagcagaagcccaaacaaaataggaaactgatagagaaccctagctctagatctttttgtcttataccatcctagcataagcagaagggagagaagctgttctaaccacgattgaagaatgaagctatttagcagcttaatcgaaactacgtacctttgaatctcttaattttaccaggctcttctacgtggacctatatttcggtaattataatggtaatgtggattgcgggaagatatcttcctcttatggctccccactccaagtctttgatttccaatcaaccaacaatttttttaagattatttatgttaatccttccactcttcattgcctcatttctaaactggagaagccctcatttcagtaacaacaacaacaaaagtgacatgtataggggtgtgtgtatatatgaaatcccaccatccttatgaaagtaatttttcccagttttctaggttcatgacgttaagaaagctgaacctcaccagagaatgtgtaatatgttaatatcccccaaaagccaaacattaaacattacttttattagctaaaatttattgaatgcttactatgtgtgccaagaaatgtgcttaactcttttttattattttttctgttggagacaatgtctcgctctattgcccaggctggagtacagtggcatgatctcagctcactgcaacctctgcttcctaggttcaagtgattctcgtgcctcagcctcccaagtcactgggactacaggcatgtaccaccatgctcagctaagttgtttttttttttttttttgtatttttagtagagacaggatttcatcatgttgcccaagggtctcaaactcctgaccccagggaattcacttgccttggcctcccaaagtgccgggattacaggtatcaaccaccatgcccggccctaagtgtgcttatctctttataggaattgcctaactaccgtacagtgcagaaggtactattattagcccaatttacaggtgaggaaactgaagacagagaatggaagagctaacgtttgaatctaggactgtctgactctgcccaagctcataatgactatgctacatcaattagtattattttctgtctcccatgccttccccatgatgttcgtctttcttttctcctaaattcatgcatccctttaacaaacctttattaacaacctaatataatacatgctagtcagagggctaaatacacatttctgttttctccatttcactcattggcactaagttacctcccatctcctacaaccaggtgtaaaaattcaggtgtcagccctgaacctgccatgtgtgggctgaggcaaatcttcactgtttggactaatatggccttaggccagaaagatgcacttgtaggctctactctgagacttgataagtcatccttgccatgagtgtggctctagccatgtgtccactctgatattcagctcagttcattagagaagccagtgctgatcactggcctctgccttgttccctttacctgagtctatcttgaatatactcaatatccagttcctctagaaccagaatgccacttcgcttttgtcagtccccatccatggaagcttttcgtcattagaatatgcattccatgaaggcagagatctgcgtctgtttgtggaagtatcccaagctcccagcacagtgctggtacacagtagcccctcaatgcttgtgggttgaacagaccgaggtccttcagctgaatcccaggctggctgatggccaggctgcttctcactagacttcctccctcttttctcagtcttaagacatctaagcagacttcttgggaaactccacaagctctctggatgtcctgatgccaagtgctaccagaatccggtctgttgctgtaattttcagattgtgtgccttggctgccagacgaggccttctggcagcacctgcaaggtgtgtttgttggcatacaccagctcatgggccggtttccagcccctcccagtctgcctctgccttattaggctgtgttaattggtttgagcctagttatatctagaaatagtgtccatataattatatacacaaattatgaaaaattcatagagatttatgttcaaagatataacagcaagaaattggaatgcatgataaaactgtcatgtaaaggacagtagatacatacaatctacttcgattctaccattaaaatattataaagaatatttgatgacatgaaaaaaatgctaatatttttaaagttacaatactttacatgaagtatgatcctaaccatgggaaaatgtatttttaacaaaaaggccagcaatagtctctaggcagttggactatgagtgattaaggattttcattttcatttttctacatatttctacatttccacaataagcattcattacttttgtaatgtaaataaaatgagtgtagtattgtaaaccagttctaaagcagatatgacaatcccttgacaatacttagcccaaacatctcagccattgagatctgaattactaacctgtgattatcagtaaaccgaatacataaacaggatgagtgcagtttgaattttaatttactcccatttcaagttagtgaacaaatctacagactgaagtagggtactgcctgatcccatggcacacaactcaagtcttctgaagtgccctgcatcgtgccttgttgattatacttactcgtggactttactcctttctcccacaaggctacctatcagctagctttctaaggatattcttttagtgcctaacacagaactctgtgtttaactggtgtaccacaaatgcctatggagcaagttaatttttgaagtgtaccgaattgatttcaaagcagtcagcttcttccaaagttgtcctggaaaacagaaaaacaagaaaacaggcagtccaattgaaacaatctctcaaactcttctgtggtccaaaagtcactcctctgtctgtttcaacacaatgacctgaggactcttggtatttgggagggaaaaaaaaaaagcctacaaatttggaaataagtaagctgttctcctccaagaacaaaattctgaaaggatggaagaagagagctattggagaggtagctaggggttactgattttaatattcattggaaaatatataacagactacaaaaccatgagcttatggctattaatgcagttgtaaatgggacaaaaagagtcaatttaaataaatctattttgttagtatagtacaagtacctgtatcaaatccactacaatgtacacttaagaatcacatattttgggccgggcacagtgactcatgcctataatcccagcactttgggaggccgaggcaggtggatcactttaggtcaggagttcgagaccagactggctaacatggtgaaaccccttctctactaaaaatacaaaaattagccaggtctggtggcacaggctgtaatcgtagctatttgggaggctgaggcaggagaatcgcttgaacccaggaggcagaggttgtagtgagccaagattgcaccactgcactccagcctggccgacagagcgagactctgtctcaaaaaaaaaaaaaaaaaaaaaaaaaaaaaaaaaaaaaaaaaaaaaaaagccatatattttgctgtatgtaaatttcatctcagctttttgttttttgttttttaagtaagagaataatagtacaagtgctgtgcagatgtggcagaaagcccaaggcattatgcggaaacaaaagcccaaaaaataacgtgatcattttacaaacattcactaaacacataccctgtatcaggcactggtctacgcagtggtagtagcctagtctttatccttatggcagttacagtctaataggagagaggcttaactcaaaaataatccatacgttcattccagctcaccaagcactgttgaatccaccatcttatttgatcccaacagagatctcctgaagttggcagagctattgctagaagtttgcaaaaatggacccagtgtacagcaagccctataccccatcccaaagtaatattccttcatatccatgtattttcaagatgttttacatttttattatgaagaaaaccaaccatcttggtttaaagtaactttgttaatgttttgctgtggaacaacatataataatttaaatataaccaaaagatccattgagtttggcctctttatgttactcatataaattacgaagactagatctgaaactataaagcttttaaagctgtcaaactttagtgtgcatgggaattacctggagggtttgttacccacaaacagctgggtcccaatcccacagtctccaattcttcaggtctaaagtgggaccagataatttgtatatctaacaagttcccagcagatgctgatgttggtggtcccaggaacatattttgagaaccactggtctagattaaattgtgaaacaacctgagtctcagtggctcaacagagttttgtttactcagtaggaatacgtgttctccacaggctggcagaaaggctttgcttgttgcaatcactcagaaatcatcactctcaagcaccttatggtaccagaaaatgaggattcctttcaaaaaacaaaaaaacaaaaaaagagggaggtgtctctgtggcaaaggggcacagcagacaactgagagtttccaatggccaaagctggaaaaatttgagcaacaaaatacataaggttgtattagaatataacccaatgtacaaaataaaatacacatgaatctatattgatatgaataaatgaatgaataaatggggcagaaaagacaaatctcctatgcagaagaattcaaataatgtatgcagttactctatccttgatatggtttggctgtgtccccacccaaatctcatattgaattgtagctccctaatcccctcatgtcatgggggacccagtgggaggtaactgaatcatgggtgttggtttttcccatgctgttcttgtaatagtgagtaagtctcatgagatctgatggttttataaaggacagttcccctgcacctgctctcttgcctgccaccatgtaagacatgcctttgctcctcctttgccttccaccataataatgaggccctccccagccacatggaagtgtgagtcgattaaacctctttttctttataagttacccatcttggatatatcttcatagcaatgttgaaatggactaatacaaccctcaaggtagagtctaactccccacttcttagctgtgggctgcacatagggacctgccaaagaatacagcatggagaggggtgagccgtttacagtagagaaacctgacagtcactgctgcatcagcctcaacagggataactcattttgatagtatgttacttcaatatgatgtaatgaaaatgagactaaactagtgaaatcccaataaaatgagactaaactagagaaatctcaataaagcatcaatcttacttataattccaaaacaaaacaccaaggctccctgagcagccaccatctctcaggttgttggtcaccttcactggggaaagagaagcctgaaggatctggcaccagtaattaaatgtgcccaggatggagggagtacagaactatttgaacagtatcaatgactgccacagcacctgcttgcaattctttgaaacagaacctttgttcacttatgctgttctgcagattctctggagtcaacctctaggtgaatgggcattgagactaagcctgctgcatggtttccaggcagagattatttataccacatctcatattttcctgcctctcaaagtgcctctagagttatatatcctaatggagaattctagtctttcttctccaatgattcttttgatttatctccaaatcaatgtatcatcacaaccaagtaggttattattaaagaggtgtttggtggtttacccaaaaggcataaatgagtttagatgcctcactcacttgtttcagtaaaacaaaagggggagttccttcctcatatgactctgctcaaccaatttacaaaccaagccttcgacagtctagtctgagcagaaatcaacatttcaaactgaatgtgtttcctccctccttcccattgctcaacttagttcttaaattctgtctcttcctagaaagtttcatttatttctcatcttttctatgcctccccaaaaaagcaaaaaaccaaataattttcctttaaaccccatcccatatcttgcccctgtttgcatttctctttatatgattgcagcacagctttagtattcattttacgttcacatttctgggagttacaaacatctgaccctcagtgggcaattctggttacctcttcccaaaggacaagatttgaccttgagattgcttgcaaactccaaagctgtctctttccataaataaatattctttacattttttataggctattgaacaaccacaagaaagtcttgcttctttgtaggggttctgaggtgatagtaggggtgatggtagtagcagtggggtgtgtgtgttttcattttcctttttctcctaatgcagtgtttttatgggacagatatgttatggtcattcaaatttggaaagctgtattaatatcacacaagaaaggtactgatgaccttatttctgctaagtattaggtgaccggaccttcctattttgcacagctcagaattgtgaaagtgacaggctaagttctataaacattgctccaaaatataatcacaccaagatggaacagtgtttaacccactaagtgtacttttcttaaattacctctttttacaacattacgaaattctcgtttttcttaactgactcctcctgcttgaaacgatccccatttaattacaacaaattcactaagatggctttgaatttttagccttgccaaaattatagatcctattttctggagtgagaatatttaactctctttatatttgcaacacagttctcataaggactaaatgatttaggagctgccgagattaataactcatttgtatatatatatcatctactttggcccaggctccaacactatcaacacttaccctaaattgatgttccctatcctttataagagataatgaattcgtctcatggcctagagcacacagtgacatctatggtctcaactgatgtgaatcaaccctctcagggttgggaatatgtcttaattgtatacttgttcttcaacacaactactgcttccatttgatttcttcccccttttacttactgaaatgattttcattcttacctcactcatcaacttgtcaattagagaacaggagctatttccttttttgtttgggattctggctgcagcccaggcaccattttccaagtaattaatgagccctgcaatgtcctggcttgtgaccaccagtctcttcctttgttatattacatcttgcctggagaaggactcaatgcaagagcaggcaataggctgccacttgacaaagagcaagctgttatttttaggtgaaaacaccgagttttttttttttctttacttttgccacatgacaacataggtgttggtagttaaatcttaggctcacaaagaaagccctagaagcagaagtatctatggttatggatttctaatagactgtcaagagctgcaatggagcatacaatcatagggtgggaactcgaccttcaccctcaccctcaagcctaggctatttgcaccacatcagcatatgagagaaaaaacaccagggaactcagtttttggtgaagggcaagaagaggtcaaaaggtgaaaatggactttttttccccttccttattccttagttgcaaggggataaaatagtaagcttttcttcattatgatcattcatgcattcaaaaaatatgcttttagtatcatctagttgttttaacattgttttaggtgctaaggatggagtactcaacaaaaacagaatccttatttatctacaaggcacagtctagtgaaaagagactgaagtgaacaaatgaatgaatgaatgatgaatggatggatggatggtagatggtgatgaatgctacgggaaaaaaattaaacatggtaaggggaacagggaatggagagggtggggtgttattttctataaggtggtcagggaaggcctctctaataaaatgacatttgagtagagacctggagaaagtgaaggaacaagcaacagaggtgtctggagaagaggatcacaggcagatgaaacagcaggaagaagggcactgcagtcagactctgcttggcgtggttgatcattaattactctaaaagcttaacaatctatgcagaattgagtcactgtagataaatgccttcaagtctctacactgattttatgatttttgaagaaaaatcactgaagctgtattatgtaaccttgtgccctattaaagatatggtccataattaaacattttctgatgacttggatatgtaagtatgattccttatttattcatatacaccttgcgcatgtcatccttgcactgcactctacttattctttaaattattgagcagccagtctttggtaggtctgtgctagttactgggaatactgtggtaagcaaagtagacaagtctctggcctcatggagcttatagtctgataaatatattattcaaccaatgtgtatcactataatctgagtttagcaccccaccagaatgtgccgggggtatgaaagcccaaacggggcctgggatcttctggaggatgaagaacagttttgtgagaaagtgacatggagttaataacaggagaagaacattccaggagcaggaatgtgcaaaggtcttgaggcaggaggaagcaaattaggttttctgtgtaaagagaaagcagtatgtctggatcccagagagtgagaaagaacagcactaagaagaaggttgtgttcagatcatcctgggccttgtaggctaagtttactcttgatcacatgggaaatcattcaaaaggttttaaacaggagagagacatgatcaaataagcattttaatatgactttactggctgcacagtaggaatgtaggggctgcaaggataacatcaagggacagtcctgcaggcgttcatatgagagatgtgcaatgcctgtgctaggacagtggtggcagagacagaaaacagaagagagaaatcaggaaccatttaggaaataggatcagctgggcttggtgatgaaattcaggagatgatgtcatgggtgactcctagttggttcttggagttgtgataatgcccttcactcactggttcatttgctgaaaaaaaaaaaaaaagaaaagaaaaatgacaaaaccctagctcaggcaccaaacacatagagcacactctcttctctttgacagccaagctagttctaagtagcatctagatgcctggtatacaagtcctaagtgcctgcagagctggccctcagctgagaagtgcctatcacacacacacacacacacacacacacacaagtaaagagaagccaacaggctacattagattcaggataaatgagctagcccaaatgacttcttctatttcaactccactatcattgcatttaactggtcacacctacaaagcaatcagcaaactgggtgactcattaggattttcttttcaagagagcaaagaacctaaataaagatccttgaatttagcgtacaatacccaggagtcatcggagcagcagcaatttgggggaacttcaagtgtggtatttcggtttgagtggggaagttagaaatcagaactgatctcacaaacaaaaagcttttataatagcctgtcctagataagagagtaatgagaggacaaaaggggaaagccatccccctcttaataccaaggaaacctagggaagtgacttcttaaaaaggaggtaaaagcagcagttttagtcactcatcaagagtgactgttcttcctctttgctagaaatagctaagagagtgtaaatcactcactaggctctaagaaaagaagacttacaaatgagcttgaaaccaaatagtgctgtgtagattcttctaccatcttctaaagaatctgcatggacttacttattcactgttaaggttgtctgtgcatggtagccacagtgctaggatgatatctatagtttgtttttgacaacaagtaaatccattataaacccaatttcttctcttgagcacaagtttaaaaggaaaaaaagaaaagcttttctactttaacatgcctcatgcctgtgcttccaaaccagagcacaagtactccctggggcactcagctctatgccaagtattacagcagcaggaaaccatagattttgtttaagtcaacctttctatagtaatttcattaacataattttaaactgacgcaacaatgattatcatgtggcataaagagaatccatctaaattttaaggatataacagaagattccaaatacatttcatttttgtggtttccacaccaccaccgagtgaagcctttagatctcttgaagaggatggggtggttacaggccaacgaacgtatccattagatgcagacagcacaggacctagagcctacagtactttttgcagtcaacaaaaaattattcttattttaaaattagaagataaaaactaattcttaggccaaagaaaatgttttaacatataatatttgtcttacaccaatgaggttataaagcctaatttttaactttttgttgttttatttttcttggagaaaggggcccacggaggcaaaaatggggagggcctacaacagtcatactacagcaccgggtagtgctttcatttgtgtttgagtccctctcctctgctatgctggtaagcctcaaacacaaatgaaagtgttatttcttaaagtatagtggtccaaataccaacatgatttagtgagacaagggcaaatattttaatttaaaaagtatgtactatatttttaaatatagctgaaaatattgagtttctcatttacggtagcaacgaattttctttttgaaaaatttaagtaaataaaatactttaatgaaaaatattaagcaaaaagactgcaagttctaggatgaacttggaaaaaaaaaaagaggttggtattgctgaatggctgaaaactagtgatatcctagaatcctagaaatactaggattcagactctcagctataacacccaaaaaagtttccatatagatcatcaactaccttcatctctcaagaaaaacagtaaaacatgaccagaacttccaccaccaatctactgggaaaattagaaattttggatagtggtctgagtgcttatttatattttaaatcacatatcatatttttcagaattagtggttcacactggcaagagagcaagaaatatttgttggttggtacaaagcacctccttttactagcccatgaaacaatcctacaataactcttgtattgtacaaagagaggcagatgattgataaagattcccacaagaataagacattcacagaaaaatgagatcagccactgcagtcctaccagctgggataattttacaagggtcagacagctccagggcataaactaatcacttcagggtgaggaagaagctgactcctgattcccaagaggcagtgtcacacaattagattgtttattctagctcaacacaaatttgacacatttccccaaaactgcctgtctagggtcctgtcaaaacaggatgatggaaagtcagaataatgttttagcccagtatttccaacattcctgtaatccattccatttcagtcatgttttgatgtaaaggatattttccccactaatatttgaaagctatccattcttgcgtattctagttacaccgagcatacattcattgtggaataagcagcagccaatggtatccaggatcttctaaaagtagtattcgagggctttttttgtatgtcttaaaattgttaaatctgagtgaatgaacttatctactcccaaagcaagatcttaagttgtttttagtggccaatgaaatctttcccagggagctagaagatgggctacccaaaggaaaatattctatatatttttcaatgaacatatagaagaattacagaacaaacaagacataaaatacaacattatagcaaatgtttttgaggagggtgaatgagattcttaattagttcttttgcctctgccaatattgtctataccattgtccttacacaatatttacacaaaatattgcagctaataagcagaatcaaaatttgaactcagatctgcttagatccaaacctatggtcttaacctctgtatttgttccagaacagttcctggaacaaagctggtagccaagaacaaacctggtagccaatccgtatttgttgaatctgaatctagattaggaaccaggctgtttgatccaggattctgaggtgtttctagagctctttacaactaatctcaacacccagaatgaaaaagctctctatgacatttgaagatattagatgactacatctgataatgccacattcaaatattttctgttaattcttctccctgttgaaatccaattagcatgaggaaaattaactactgcaattaagaggaagaggaagtgaaagatttccatataacaagtttaaagctctgttgctaaaaaaaaaaaaaaaaaaaaaaatgcccaaagaaactcaatcctgtaactgaatttcagataacagagtatactgcatacataaaaactaacttttttgagtactcactgtatacctaaaattcttctaaatgccatttcatgtattatctcatttaatccttatgagctaggtactattattcctaaatttcagaagagaaaaccaaagcacaaagaggttaagcaatgaagcctaggtctaccaataagtggtagagccaagattctggtcccaagggatacaaccccaaactttatgcttttaacctgctgcttcccataataataacacttgctggacactttaatctgtctcatatattcttttttcttaacctccacttcctgggttcaagctattcgcgtgcctcagcctcccaagtagctgggactacaggcacgtgcctctacacctggctaatttttgtatttttagtagagatgacgtttcactatgttgctcaggctggtctcgaactcctgagctcaggcaattcacccacctcggcctcccaaagcgctaggattacaggcctgagccaccatggctgggctgccctatgtattcttcatgcaaactatgttatttactttccccaacaaccatagagaaaatatatatatatatgtatatatgtgtgtgtgtgtgtgtatgaatgcatgcagatataggaggtgtgtatatgtgtgtctgagtgactattctctatcctatcactgtaaaaacacttgacagatctctcaaccattgaaagaaggtcatcttagatcttctatataattaatcaaaagaactattcatacaaaaattgcattatgtgtcatcttcatttttcattaggtattttgattggatgttgtttttgagaggaaaagaattcatttattctcatgttcttgttctttttctcattttaatatgaaataacagcaccagagaaagttccaaaatatcttgaaggacagagtttcagggctatcattgcatttgtaagagttgggaggaaaatttccaattcatagtagtagccaaatgttgcaaatcttcatgtaccctccacctaagtattacagactctgcatcatgtaacctggttactgccagaattgagatctcccttctcctcttcacttatccaaatgtgtgattcatctctgtgggatatgacaaaccaaccacactgggcaaaaaggccctgcctgagccctctcagttcccaggagaaccattcaacacaaaagttaaatggtgcatttcaggcaccctgcccatcctgaaccctggatttatgccaaggaaaggcattccactaatcaagctatctctagtcctcaggaccaaggagatggcctaatctcatgcttcccaaagttaaatgggcatataaatcacctgggagtctcgttaaaaagcagattctgcttcagtgggtttggaaaggcctgagattctgcatttccaacaatctcccaggaggtgctgatcatgctgctggacagcaggccacacctggagtatcaagggtctagttcatacacaaatgcaaaattgggcttcaaagagaagtgtttgattttttgaaaggttcatcctgggttctcatccagggtgatccataaaattttccatatcttcatgtggcattaaaaactccagacaatcctcagaaaaatctattcaccttttaagcctttggattccacaaggctaccacaccccaagtatggagggagaccattattccatacataactttaaaggcatcccctttgtgacttagccacatgttcttttgtgttatttatccaaagaataagcaactgataatttcagattttccaaaatggcgaatgtttgacataaatgtgtttaatactctgcaaagcctctccaactcagtgtatttgggatgcaagggttggtatcactatgtaaataaggaactactttacagtacagtttaatgaaccaagtacatgcaggaaccctatttaagtgaaagtattaattccttggaggaaatgctttaatactgaagaatgacttgtgattagcatatcaacaagaataaacagtcttaagatacccaagggtacttaaggacagaagctttcaacaaacttcttaaactcctgtttatactcttaaattgcttggtaaacgcctccttctaaggtactttaaaaggtcaagttttgcccaagtctcctctctgaaaactaatgaggctttaatgtattcagaaatgcaaaagtaacatcaaagttatttgattgacccaagccaaagaaccttctagaatagcaacatattttggctgggtttctaccttaaagtcacctctcctcctaaataggataatttaaaaaacatttatttcaacatattggcagaattactaggtcatttgtgagcagaataattcttttctacctttttagaatggtcagatatgagaaacaaagcatgtaaacaacactaaaggtggctgctctactttacaaggatcctaagaactagaaatagtagtcttcagttaaaccagaaaattttaaattaaaggttagatgactgaactcttgcactgagcagtcgaccccaccatgctttcattatgccaatgaattatatctgtttcaatcactggtgtcaaaaggttgtgggttcaactccaggttgtgccacttactgtcagtgtgacctagggtaagttaaattttgcaaggtttagacttttcatctgtaaagcagggatactaagcagtaagtgcttactttatgatgttgcggaagcctgctaccgagcctttcctataatgggcatagttactctatacatatactatacatacgggattacatactattgctacttttactgtgcacagaacaaggtcggtccttgagcttttaaagagacacattaacaagtaaagacaagaactgccaaccaaagcacatactaaatctatgaaacacctgactacaagagatgactcaggattaaaaaaaataaagagatggctcttaaactatcaagagttctgaactcatcttaacctctgaggttcaagtctaggaagacagcaatattcttctgcaatgtgaccttccacatgggtgttttgcctacaaatcaaagtttttattttggatgcccagccttcatccaagctgagttaaaaagttaacttattttttcttctcttagtaatagtaggcagtaatgattgtggtcctggtacttcttcagagttaatatctatgatttcttaaaatgtttattctggagaattttttgtagatatcctctaccctccaaatgcccccaaaaggtgtatgttagtataaagtgccattattctagcaaaatcagcccttaagaccacattcatgtcttagggtgacactgcgctaccaagaaaaaaaaattttcttgaactgataacaatttagaaactcactcccagtaaagcatagaactcagcacaaacaccaaattcattatatatatgtaatatatatgtagatttacacacctttgtatagctatccttgttttaaaaaactaattttcagcattaggcactttcactgcttctgctctaacccaaattgctgattgtaaaaaggggattttctcccctgtatttactttggaaacagacaccagccacggagaagtagttgagtgcaactgcccacagactcacactgaaattagagcacctgagctggtccactacctgagccgtgttcctcaaggaaatttcaaaagaaaacctccaggacctcggagggccaaaagggcagcttgtagcaggactcggctgacacaagactaaagcctaggagttctctgtgtccttacccttgggcttcctgagaaacaagatcctgagtcagacactgaaatcttatgattatgagcaaatgggcctcataatcccaattaatctccagagttgattgttagaaatgcaaagatactccctagagactgttgcacagactaaggagtttcttcaacactgagaatgtagattaagactgctgagggagaaataatttaagtagtgattgggctgtgaaagaaaacattgtcaatacctatcttacttttagctattcacaaatatatagatttcagagagaggtaacaccatgatgcatagtacttaggccaaatttcaaagagcacatctgaccatagtattactcatcaacttaatcaggtagccataaatctcctatgcttctagactagaaaacaatactcaaagagcgttctgttttcaatgttgctattctgttttgggttctgttagcagacttttttttgtttttgtcttttctgtcttgtattttcccccatcccctgtgaacactggattcttggtcacatcttaatttatgactatttactcagctgattaaccgtaggcattcgtcttattcaagcaaatcttgttctgagcaacagataaactggaaccccaaggacagagcagccatggctccgtattaatcatctgctcatcccatttccccatcctacagcagaccatgaaagctggggttgcctcagagggcttggcttcaggcacctcctccctgaagcactctcagaggggcatattcatatggagcaggagggaggctttggtgattggcttctgtgataggtttcttgagggaatggaaaggttttgaagttctgaagtatttgaagtgtctcttcataagttcacaagtgggtacaaaatggtagaacaaaatgtactaaacatttaggccacaaaacattcattttctccagctgaaatcaccagaagtgttagctggggagaaatcagaatctgcctaatttgcaactcttttgaagagaatataaaatcagctttgcctccacccaaagaagaggacacactgtcctgttttcactaactttcactattttgacaaagagaaagaatgagataactctggctaaaacttgtcatgaaagtatctgatagaggcatctctagcattcctgggttactgatgttatataactaaaacctgtaaggaaaaaagtgaataatgtgatccttaatggaaacggaaatagagagtcacaggtattcctaacttgcagtcatgcaaattatccaagagattacatctcggtattgtagccaggtcatcctcctctacaatacccagaaattctttctttccatcctctatttcattgtctctccccaccctcaaccccaaacacacaaacctaggcatccctgtaaaggaggaaatataaaagcaaagagtaagcaacttgctacaatgccacaccaggtaacaggtaactggccttccccctgcttggaatagaggaaaagtacaaattatacacctggcaaatatttgcgtggtctccagagcagtaagattcatccatttgctcacaaaatcacacaactgaagctgagcgaataaatcaattcaattcatttcaacaaacatttatcaagctccagtctgaatatagagtttttctggggggaaaaaaaaatcataatgcacctggctattggagctgattttttaagaagtctagaaatttcttcctcctttctgagaaacgaggcaaccaactcccttaaataatcaacacagatgtattttatattgtaaaatgtaagtagcccaaggtatgccgcttccttttttgtaggtggaaaagaatccacttcttatctttctgggaaaacacaattgtgtttgttgtacaaaaacacagtgtccccatttactaagaaatcaatgagtaatcaccaagccatgaatcaccttttagtatttttgctataaagatgagaagcactatatattgaaacaggctatggcatcgctgctctatagtataaattcagacttatcaagaatctacttaaaatattctaaacatgcaatggaagggcagggcaaaaccaatctttgccaaacatttaaggagatgttatacacaaatttcctcctgggaaacttctgagtggaggtaagataatttaggcgactcgatcaggagtcatgctctactacttacctgggggcttcaagggaagacatttataaactctcagacctaaatttctctcctttaagacaaggttaatcatacctcttctatctaacttatggggttactgtgaaggtcaaatgaaataatgaatatgaaggtttcaaaaccattgttttatgttttatgattgatatcagtgatgtcaacgtttaactctacagtcccaaagacatggtagaagatggaaaacaacctccaaaaacccatctctgatatcaaaagtgtgcaatgggctatttaaaagttcagatgagctgtggttctttgtgcttagccacaaaaacagccttagaatcataaagccagttttaaaaagaagggaaaacaatttttttctttgtcctattctcttctgtcatattagatggtaggcggacactgtttttacttatcaggtatcaaactgctgttggctactaaatattatattttgtgtcagtctccttaatttatatactcaaacagttgagatgaagcaaacctaaacatatctcactgagttagggcattccaaactcagcagaatttttttttttttttgagatggagtctccctttgtggcccaggctggagtgtgcagtggcatgatctcagctcattgcaacctccatctcccaggttcaagtgattcttctgcctcagcctcccgagtagctgggattacaggcccagaccaccacactcagctagtttttgtatttttagcagagacggggttttgccattttggccaggctggtctcaaactcctgacctcaggtgatccatctgcctcagcctctgtacttttttttttttttttttggtacatatttataactacctactctgtattggtactagagaaacagtaaggtaatgtccctgactcagtttggaataggagacagccagacagaggattacaaacaggtcagagtacggagagaagaggcagggaaaaccatcaaaccccattgggcaggtgctgcctgaaccaagtgttaaggatatagtatggttgctagccaacagggggtgaggaagggcacagcacggataaacagacaccgtgtgcagtgtgcacgaatgccccgcaatgtgctaccatagatggacacagtgggaatcaggatgggccgtagatgaggctggagggggaggcagaggtcatgtcataggaacctgtgactggggatgtagaactgtgctccctggagctccaagtgtggggctactctgtggagggaggtagaggtgcatcggggagtgttgtgtcggcaaagggacggctccatgaggtagatcctaactatcctcccagaacatcctgctattgtgtcaaatactggagtttcctgtgggggaaaaatgttttgctgctttaaaaaatagttgatacatttaaggtaaagagaaatctcatttgtaaaattgtaataaaaataaccacagcccagacattttaatatagaaaatgtattagtctgtttttgcactgctaataaagacatacctgagactgagtaatttataaaggaaagaggtttaattgactcacagttccacatggccggggaagcctcacagtcatggccggaagtgaatgaggagcgaagtcacatcttacatggtgcagacaagaatgcttgtgtagggcaactcccctttataaaaccatcaggtctcttgagagttattcactacacgagaacagtatgagggaaactgcccccaggattcaatcatctacacctggccccacccttgaccggggattattacaattcaaggtgagatttgggtagggagacagccaaaccatatcagaaaacatacacaatattcttttaggattcatacaaaatgcttgcgtattttttgtggacttctacctgagaaggatcgttttatttagatataaacagggtagaaaaatcaagggcttcagctggtttcagcttcctagaacaagatgcagccctgcagttgtggggcggtcagtcacctgcagataataaagtgggctgttggtgaggtaccttggaggaacgccaacgtaaggacagacagacatgcagacccatttcaagcttgttgcagatccagtgttgcaggacatgacccaggaaaccaccacctctataattaagttttaagtttactaacagtatttttttaaacagagatcagggcatggggtggagtgagggatagtagggtatggggagttaatatttaactggttcagggtttcagttgaggatgatgaaaaagttctggagatgggtagtggtgaaggttgcacaacaatgtgaatgtacttaatgctgctgaattgtatgctcacttaaaatggctaagggggtaattactgtatgtacgttctacgataagagaaagaggtaccactaaaaagatttccagtaagataaattcagctaggagcctcataccacctccctgaatgtgatgcacagatcaaaactgaatttctcaagccatactcgaagtatcaactcgaagatgttaaacagtaacgggcaagttttctaaaacaagaagtcaccttctccttaaaggagactgagttcttcacatatggagttcctaactcttccctgctgtccacaaagatgatatggttattattatcatgattgttgtaacagacattttgtaatttatctagaaaaattgtgtaaccagctgctacacttgtctgcctttgttgtagagaggaacaaaatggacacagtagttctgtgcttctccttgcaaagtgagcaacaggaccaagatccgaagcaatatcagaggccactgcacccagcagcagaggttgtaatgaccccattctagaccctcaccaccaacaacgctcctatgtagtagtaagcatatatttgcttgccgaacagcagatatttctttttgcatatgcaaaatatccaagcagatttaatgaaattatacttaaggttaaactacagagataagaaatacaatctcaataccacagttaattggttattctttttattaaagagtctcaaatgtttcccatgtacaaaatagttaaaaaccgtgaagagccctaaattctgtgcctgtaatcctggcggggtttcattttacaggttacaaataacccagaatagtaactattgatggtttaattacttgaaagtgccttataatcacgaagtcattaagggtgttatgagatctaaaaactacaagtcatgagggggttgtgcatcaagttatttggcaactcattgatacaatatgaggtggaatgaaagtattttggactaaagcattctaaatacttcaaatcaaaattgagcacacgagtgccaatccatgtccatccctaacagaaaatctcatcctcttttcatcactattagaaattttgtatcatcattcactgaggcagtgagaacctgctaaaaccttgcggctctgaattaatgagagaatggtataaaatgtgcatgtgtctacatccttcaacacatcaactacaccaagcaatgccaccaggccacatgggtaccttaataatgttaggcattccgtataaatcattttgctaatggtttagagtattgctgtaacagttttgcagttggaaaagcacaggctgtaagtggattcatggaagcaacttgtggaggttatccagactagtgctctacttagaattaaaggatgtcatatctagaaggaactctggagaccctctagccagacctcttcgttatacatgaaaccaaggcccagaaaagctaaatgacttgcttaagctcacacagctaatgagtctcaaggccaagactcaaggccagaagagccatctgtccatgtctgtcttaaaggcttcccagccctacttcacctcaggttattgaccctggcccaggccatcaaaagcagtcaagcctttggtaacactacctctccctagagtacctacttaattccccttccacatacatctattcatcttttaagactccactcaagagtcacctttatatgaaggctttcctggtcttcccacagcccccacagatttggctctgctctgtatactcttgctgtggtgcatggaatacaacattgaagtgatctattttcatgtctctccacccagagacttcaaacccttggagggcaaggaccatgccacatgtttatctataaaccatgccctgatggcaatgccaggcagttgttagatacttatgaaggctgacactgaataaataaacaaaggtaaacaaaaccccaagatagagctaaaaggggtagactcatctccaaagacaaagatacccaaaagagcacttacactacagacagcctcagcccagcagctctctatcctggctgtgcattgcaagcatctgggaaggtctggaataaaaccttccccagcccaacatcagacaaaccaaaatcaaatttttaaagaaaggcccaattatctatagttttgcaaaattatccagatgatttctataaaaagtgaaggctgcgaaccactagtagcaataagaaatcccacacagtccctgtatcaagttttggtagcaactctacaggttcaactacctagtagagcaatcgacccacccatatggcatctagcacacaggcacccacgaaggtcttccctccatgttcacatgacaaccatctaattcattatactcaacagatcatagcacaaggtggcatggtcttcagacaaattagatgcaaacaacttggggatctatgaggatgaaaaattcatcaagccaacatatttcaaaggtgaatgattctcctacttattggagaatggaagtaaaattgttacctttaattctagcaaaactacactttaagaacagataataaagcctgaggatgaagaagagaaataacaacataggaataaacttccccagaccccaagataacaggaatctgccacctcctattgtaataaatgacaatagcagtaatcaaaccttacatgtacataggaatttatatttaacaaaatactttcatagtcattaattgatttcaacctcacgatagcttcatgggttatatcatgaaaactgtttctttatattctaattttacagatgagaacaactgaagttccaaatagatctatggcaagctcaaagctaaggcaagttaagggtagaaccaaaaccatacaacgggtcctcaatatctaaatgaggttcttgctgctccacaccccttcactaatctcacaataaagactctctcctgagaccttatgctacctgaagaagaaatactgttgcttctcctccaaaacttgtgaaatataaaattattcagaaaccattttcaccccaccaaagttccacagtgctgcaactgattcctgtttcctctattaacctatcttctctttacacattattgagacattggcttttttaagcactaaagaccaaatataatatccaagtggcaattatatcaccaaatacaatgtaagaattgtattaggttggcacaaaagttactgctgtttttgccattaaaagtaatactggtattaggttggtgcaaaagtattgtcgtttttgccattacttttaatggcaaaaaccacaattatttttgcaccatcctaatatttaatacaaataatgccattctaagcatacataaaaaccaataaatcaaatgtagaatgtggagcacaaagacatgtgtttctaacttcattcctctatgaatgtttcttttaggtcataaaatgttctatgaaagcaagaccatgggaagaactggcacatgtgtttgggaagaggaaaaggttattgagtgcctactatgtgtcaggcactgagctgaatgcttccacatattaatgttttatacttgagttttcattaacagctctaatctgtactattaataaaagataaagaaatccaggctcacagggtaagttgattatcttcacatgactggaacagagcaaaaccagactaggaatccagctcaggcagtcctgctccaaagtccttttcattatactctttccacttataaaaatgctcaattacactcccagatacagtggaaatgccaaagcctctaagctttttccaaacccacatcttgtgcccattcaggtccccactctgcctggacagcattaattcctaaatagtctacactctcaccatccccacttgcacctcaatgttaagagttttgccattctgtgtgatttttagagcagtggttttacccccacagaagacacaggaaaaactggagacattttcagctgtcacaacttaggggtgctgctgctttgtagttggatgaggccagggaggctgctatatatcttgcaatgcacagtacagcccccacaacaaagaattatccagccccatatctcaggagtgctgaggctgagaaaccctgccttacagtgataatgtgatttaataaatgttcttcctccccagtaaaatgagaccataaccaccatgaggaataactgagacaatatacataaaaacctctggtgcacagtgaacactcagtcctaattagataatctgattacgcacttcttaagagtaggaacctcctcagttagctctgcattattcccatacaaagcacagggcttttttcatgggcactcaacaaatgtgaaagaatgtattctttatgttagaaattcttgattaaaaaacaaacgccactattatctataaaacacaccattctcccatactcactccttgccaaacaataagtgaatagtataatacatgattcattgcagcaggctatgaaaagctacagtgcatccaggataatgttatagaatcacctccataaataaactattaataaacttgctattgaaatgttttatcttattttaacagaaggttaatgaagagatcgtgatatacagatttgagaaaatctccacccaacaggccaagattttgctatataaggtcagttttgacaatattgattctcaggtcttgagttaaattattcagctttaaactgtaatcataagcatatcaaataaaaacactgaaagtcaaatctttgaataagccaaaacaggcgggtatcacatctcagggcaagatctttgatttttgcttttctcagtttatgtaagtttgagtcagcatggaaatcctaaaataaatgattacaaaaagtataggattagcattcactcaagtgacctataacaggataacatacaatcatttttgcagtttctggaggtgcggtcccaggaccttgaacaacagaatgagcatttatacttattaaatgttcaaagaggataccccagacccactgaatcaaaatttcagaagttggagccgggaaatctacattttaaatcctttcccaaatattcattttacatactaaagtttgaggacctctgccaggagaccagaccccagaaaattgctttgcctcattttgtaaatttctagcatagtcttgcttctgcagactactggtaattcattaaacataagatccacatccccatcccattataaaaaaaaaaaaataggtagaggattttgtttattgcttttgtgcaaatatatttttctaaagtacaaagattaacattttatgaaaatgctaaaaaaaatttaaaactgggaacaaatatagaaagaattatcaaggaaaacatagctcaattctgggccccagaagtgtcaacatttactgtgtgccagactagggatagtgatggcctagacagactaggtctctgacttaattttcccttgacttatgtatttaaattgctaaatacagacataaacaaggaagtaagataattcagagagtggcaataccataaaaacaataaagcaggttaatgtaataaagaaagtctatggcagagggaagcagaggcagtggctagctgtaatagacacagggatgaaaagtggcttccttgagaaggtaacatttgagctgagacctgaaggagaaggagccagccatgagagggctgggggaaagtgttctaagtagagggaactatgactttaaagaccctgaagtgagaacaaggtgctcattctaatatagaaattaaataatatattcaaaaggttttatggaatataaaactatttacaagcataaaacacgacttttagtgacagaatagttcgtggggataatgaagggcctcagctctatgccataagaatgaatcaagcaactgaggctacattgcctggacaacaggagatgtaagtatatgtttggaggaagaacggagaaattttcttcaaatatcaaaaggactacacaaaaggactacattcttttttttttttttttttttttttttttttttttttttgagacagagtttcgctctacttgcccaagctggagtgcaatggtgcgatctcagctcaccagaacctctgcctccctcgttcaagtgattttcctgcgtcagccttctgagtagctgggattacaggcatgtgccaccacgcccagctaattttgtatttttagtagagacagggtttctccacgttggtcaggctggtcttgaacccctgacctcaggtgatctgcccacctcagcctcccaaagtgctgggattacaggcgtgagccaccgcgcccggcccaaaagttctacattcttgtgaaagaatatttaattttaaattttaaatagctctagaggtatgaaatggggttgaaatggtaaacattttaagaaggcaggatctcagcacaatgtgataacattcaaaggaactgcaggaaaatggactgacagaaaagtaatgagttccacatgactggaggtcatgaaggatgggctgaacagccagctggcagagaactcagaatgaggactatgaagactcttatagcatgctggaaatatacacactcacagcatctgtctctcttaagcacaatagccaccacgacggcctccctactttgcactttacaaccttaagaagtattgaaaagaaatatgagaaatactgaggaatccttcatattcctaattcacattatcaccctgggataaaatatgtcttcatttccgtaataaccaatctatattcaaaagggcaaattaggagacaggaaaaaccaacatttatttaaaacctgtggctaatttgtagtggtatcttaccagtaaacattaaacaattatttcaatttattaaaagaattactctattttaacaaaaatgtgtccagattccattaggttcccaatagatggcatgccaataaacagccaagacctttagtaaatgggtatgtggccttttgttggtttattttttaatgcagccatgaacagaaggagatggtttcctcattaaaagtcctgagagtgaatcactattctttattatttacctatgctcctcggtaaataaagcaaaaaacagacattgaatcactacttgattagatgggactaaaatgctaaagataaacaaatctaaccttgcccaaaacaggaataagctaaaattgggagtaagactagaagcaactttgaaaaactaaacattattaaatggcttttatataaaatatttatatttctatatctagatgtacctgactcacatgcagatatatttcaaggtgttctctgaatacctacatatactttttatttattatattaagtatgtttctttaaaactacctgtaaacaaaattatattatgactctcttagggcagcttataaaaaagaaacttataataaatttttccataaaataagggctatgtccatatacttattcataaaattatacctgactttatgaaaaccaggaatgccaaaagagagactttaaaaattaaaatcaaaggcttagcatttgatatggtttggctgtgtccccaaccaaatttcgtcttgaattgtagttcccgtaatccccatgtgtcatgggagagaccaggtggagataattgaatcatggaggcggtttcacccatcctgttctcatgatagtgagttagttctcatgagatctgatggttttataagaggcttccccctttactgggcactgattctctctcctgccaccctgtgaagaggtggcttctgccatgatcgtaaatttcctgaggcctcctcagccaggcagaactgtgagtcagttaaacctctttcctttataaattgcccagtctcaagtatttcttcatagcagcgggagaacagactaatacagtatttaacagaaagaaaatacttatcatatgattttatgtataaggacctcctcctagagctataacatttctatttatacctacagtattttagaaacatacatattccataaaagttgcataatctatagtgcaatcactttttaatgtaatttacttaggctcacatatcttttagctcgtattttgctattttattaaactttaatcttttagaactcagaatgacagcaggactggattagtggcctcaggaaacacagggtctgctcatgagcagtgccacctaacatcgtctggttgcctagaaaccaaacccttaaataggtaggtagggagttataattctttaagtaaatcaacacaaggccccatagcatttttttggggggggggggaggggacagagtcccactctctcgcccagactggagtgcagtggcaagatatcggctcaccacaacctctgcctcccaggcttaagagattctcctgcctcagcctctcgagtagctgagattacaggtgcatgccactaccacctggctaatttttgtatttttagtagagacagggttgcatcatgttggcctggttggtcttgaaatctgagctcaaatgatccatctgccttggcctcccaaagtgctgggattacaggcgtgagccaccgcacctggccaggccccaaagcatctctaactacattctcatttgactaatacacagaaaagctgtggtggctacaaaacaatggggctggtaaaagagagcaaatctcctgtcccaaagttcactgcattcaccatgaccattctttgcagaatctcccttaaacttggaaggtgccatagtactgtatcaaccaccaagagaatggaatcctttagaataataatgttgacaacctagctgctaaatatcttccctctctaaaaagatctgagacctcttgccatttgtttccttgcctttttcaaataacaagaaattatggataattctggattttccaaatattctcatccttaattgaatctcttggtatctcctcttataagactgcagagtttcacctcttgaattagtgtaccaagctgtgaaatgtctcccaaatgtatattctatgggtgggaaacataatgaaacggaaaggctctaagaaatggcaccataaaaccaacagcatgctacagagttgctccttcatattgacagcaaatcagaagtaattttgtacctaagtcagagcttaattcattagttacttcacaagttcaatccagtttctcaaaatgcagtaacacaatcttccaacctaattatcttcattgaaagtatttaaaagcctttgctgagacacatttctttctgtgtcagacaggatcaacgtcaagtgagcaggttgggtagactacattctgtctaatggtaaaaggtgtacaatttaggaaataatcgtttcttgcaagggagaattttcccctggacaccaaaggaaacctctcgtaaataaacatataaatgtgtatccacttagaatctcgagaataccctataaataatacttttgacattctgcagaattgaaaatattacaacctgaatgatttctataataaatttaattaactgagagaagtttagggctcaggaggaatttttaaaaatagaacacgagataatttgtaatggaaatgccatcccatatcgctgccactagggaaaatgatggatatttccctagaaattatcatgaggaaacagttggtttgttttgatggcatttcaatagctcattcaatgaaaccccaaaagtttcagtccaaaaacagttcactttcattttttttgtttttttttttgacaatcagaaaaggaatcaactcacattttcaaccagccatttttcgtagattatacttggggaaaataccttttaaaaacactttttgagtgaatttgtaagcagaaattagtacacaggcaagcaagacttcttattccacagctcagtctcaactcaagtttaacttttaattatttcctaaaattcgtcgctgctattaagcttttgctttgtgaggtaacccagttttcttccaacactgttcactccactcatttaattcatgtcctaggccaataacacatctacttttccagctgtaatagtttaatagcttaaatttctgaagtagatggcattcttttctctttcaaaaaccagttctggcagtgattaagtaaaggaaactgaacgcttgaagagcttcaaatatgtgccatcagaattcatgtgtcacatacaaacacagtaatatataatgaagggaaatacccaaatcacagaatccagtttaagcaacataaccacagatatattttaaaagatggagagtcaatcaacaagtatattaattcattttaaatttgttaggagccatttatgagccagtatagacagcactgcaatttgtcattcatgaactgaaaccgtacataagccactctcagactcaatgtacttaccttataaacttgcccgtatgttccatttccaacaagttccaccaattcaaagatccctgcggggtcctgaaagaaaataaacaaacaataaaaattcaaaacaatattccaggcattgccttaatcaaaagcaaatacttatttaaattaagcaaataaataacaactttagcttcaggggctctcatgtgttaacatttaatactatcaaaattttaaaatttaagtcagctgcagctatgaaattagccaagttctattttctttccattttacatttctatgaaatgtgtttaaatcaggcaaaaggagatgctttttcaagtgaaataataaaaaagaagtaacacatttctcactgttaaatggaaaaacacacttgcaggagctacagcaagataaagtgaaagactcatcatcctgagaaggttctaatgttccagggtatttctctttgaaatatccgagctgttcattgtgttgagtgagccctggtagctaagaagggtgttcgtgcattgtggggcaatcttacctatggtagtcaacagtttccaagggaaaatagagtcaacttaactacctctctcagaaagtttttctttggattcatctcttctgtaatactgcctctacaaaatatacttttgaggatagcctccagttcctgcagtacctgctgagtaactgcaggatttagaatgcaaactaaattggagaattattcaagttcttaccaccaatcagttgtccactaaccccaggagtcagctaaatgttacagcgttcaataaatatccaaaattactgctattataactgaattactatcccaaaaagttgaaaagaaaaatcaaagccaataaaattctattcagaggcagaaattgactttcaccccttactgattcctaactggacagaaattgcttctttaaaggcataaatctaggagtcacaaacttaaatgtctacagaggccaggccagtaacataaacaagtaaagtggtccagttggggcctgtggcaaactgggcaacccgagcctccttgagggaggtagggtatggtatggtagggtggggtggggtggagtttacttagctggagccacttgttgtcttgtcaacatatgagcacaatattgccaggtctaaagatttttcaagagaaactgaacattgtatttaatgtgagatctcctattttttaagttttaggcacttaatttaaaaaacattcttaggaacaaataaaaatagactgcgcctttggcctgtctctactggacacttacataagagcaatgccatatattattacaatgggtggctaagaggcagggagggaacagcctgaacttcagattcagagagacctgggttaaataccagctgtgccttgaccagctgtgtgatcctaggagaccccgagaaagcaacatattgtctgggtctgcagggatgacatctacctagccatgctcttgtgaagaataagtgtgggctttgcacaatgcctttcaagtagtcggaaatctattaacacctaatagtaatcacttttaagctgagaaattccacaccaccagcaggatttaaatgggggaaggggaaaatgagtttatctgctattctggggaaagggaaaaatgagtttgatctgacaagtcaggatgctttaaagtccaatctgtggtaaatcaaactcaagaaaagcccctgcgtaggtgccttcaaagattccacacagagaacaaataaaaacaaaaacaaaaagcaaacaaagcacccaacagattaagcacttagtcactgagaaagattggagttagcactacattacctgctcttacaaagccagaagggcaagaaaccacactccatgctcatgtcctgaaaaatccagaagtccagaagttccagttatgccccacctggtctgggaggtgtggttccagacagaaccacaaaaccggaaaacactcttaagggacttagagctctgagtcgaccaacaccccatagttagaagacaccatcaaggccacctgggaggcctcaggatcgggaagaaaaattttgttggttaaactactaggccattagagcagcaggttttattacaaatggaattagaaagaaatgaggaaaagaaaaaaaaagcccataaatggtggcagctgctgtttgtttctaagctgtgcttcccagtagtttgtttgcttggtggtgtttctgcaacatatttggagagaagtcctacatttgcttgaaatagctcaattgtgttttcaacattcatttttcttaactaaaaaaaaaataacagaaagagaagagatacaggacagtgatgagtggctgcctcaaggaacctgggaatcaaacagggatgtgagatgagggcaggagcacaaacaggtgcagagcaggaatcagcttctacatccaaaggtcactcgcctcagggtcccctctcagagctggggttagtaggtaggtctcaggaagatctggacagctgacttgtgaggctcttttctctccttgaataatctattcttgggtatatgtcccaaccaatcaaaaccaaggaggcttaatgctgagcctttagttcaaactgctaggagaaggtttttgctggacacatccaagggcctcagaagtaaagttcagaggaactaaagagttctactggcaactggccttgcataggcaaccaaactggaaagaatcatcatatcagatgggttccccaggaataaaacctgagactccctgagatttatactgtgtgagtttattggggtatgcctcagaatcaacacctgccggggagtaaaggaagaactggactgagccaaaggaagagctgaactgaaatgtagtggtaacaaaaacttcatctgatccatggaagtgctggagctaggacagccctggagaattatcctacctggaagcatcaggactttgcatcccatctccattgactagtcactgcatgtgggatgccccccaatacccgtcccagaggtaacaatcttaggtgaactgacactgttcagctgaggacatttttcagatgaacgtcatccctagctacctacactcccagaaggtggacaactgagtgcctcagcagtggagaactgagctctgtgtgacataccacaacatacactacaagcaccatggctagaaataagaaccagtctggaatcaaaagagaagtctataagcatctacagtctacagtatcctgagagtaacaaagcaaaatagcatgagtcatggtatttgcaaggagggggctctttgaaaccctagatatggaagtcagaggtattattcagtgacacctcagtactgaccctaggctctcttctctctttcccccaatccaagcgcctggagagctgaatgtttgtgaatagtctttcacacaaatgcatttcatcattagttacatccttgtagaattgtgatacagcttgaacagtataagcatttagctgttttctccattctagagtacctctaaagtaatttccccaaaaggtcaccatgaacctcaatttcttacacatagtggttgcttctcagtcctgtcctagttgtcccttttgaggcatttatactcctgagcatcactactcctgttgaaaatatatccctccaccatcttctatcatacctcttagtctctctcacagattctataatatttcttctgctcacaccttctaggtaccttcccctaagtttccacccttgtccaccactcccctaattttgttcactaagtgtcaatgatcttatctccaaatgtccaccatatccatctactccactccattcacacaacaggcttcatcatctttttctgggaccatttgcttttagttaattctttcttccttctaagctattctccatactgatctttctaaaacagacatttctaatcatgacactccatgatttaaaataatacaagatacggttcaaactgaaagtcaaggtcatgtcattcttaggcctggcctcgattcccagccttgtgttccatcattctgtactataaccaacacatgtccctcatgtccctaacataccacactcagctcttggttcatactgcccatctgccaagattattccttctgctttctttatgaggcaagcccatccttgaaagcccagcttgctgcctcctttctgaagcccttcttaaatcagcgtcactgcctctctctctctgcagccgcaatatgttgtgcacagctctatgataaccattttcacatagtgctagcctctcttacatttctctcccttgatgaattacaaatgcctcaagagcaagcactgtaacatatttatcttggtatttccagcacttagcatgctgtccaatacataactgctagatataactatttactgaataaggttgatgtcccactcccaattcttcaagacatgtatagtgcaaatcacaaaaaatgggatcagaatgtagagccaaaggtctagcaaacttacatcatttcttttaaatctagacaagttgttttaccactgtgccctctatcctccttaccccaatcccaaatggacaaaactgtcacatgtaaaagcccctgtagtattcccagcttaaaaaaataaaatccatagagcctgttgtagtaaactgtgcctcacgtgcattgagaagacaggctgtcagaatgtggccaacagaatgtgcagcaaggagaggaagctgtacctaataatcatgttacaaagacaggaaagctaagagataagaaatccacttaattctccctcttgtgtttgcttagctgctcttaaagccaggatgagcagcatggaagaaagttacatacaccaaggagaaaagagcaaatcattgacatttaccaaagtcaagaatccctgttggccacacatgcctttattcagatcttaacctttgctgggagggtgagaagagaatttaattctaaggtagagtagtttacattatttcataatgaaatataactacatatcaaaaggtagactattccttgaaagaaaatgtaatttttcagccagtactgataaaagcaaacttggttagtcatgacaataaaaattacagtaatagtgaacatttcatgaggacttatgtgtcagaaacgattctaagcatttttcatgaatagctcatttatcacagctttatcaagtggatgctatcattatctttgttttacagattaggaaatggaggcacggagggattaaatgcttagtcagggtcacactactaatgagcggcagagccaggatgttgactcagatggtcagactccaaaccttgagttcctaatcactatatcatagcttcatggaaccataatccccagcccttggtttaccacctggtagctctctaaccttgagccagtttcagaactgcattgaacctcagtttcctcatctttaaaatgtggacaggattacctcccttgggagatacaatgagaactgtgagtgtctagactagcttggggcctgatatgtaataggactttaataaatattcattttcttcctcccttttctttttcatctttgaaaatgagttcatgtaataaacaaagaatatgccacagtaaaattcagtccgcattttatagattttcaactaaaaaagccaataaaactaatctggccagtaaacgaaaacctattgcttttcaaccaataatattacccaccacatgcttagcaaacagagtcaggtatttatggacaaaatgtatgtctctttaaaaattagttagacaattgagaaggcgcattaagttttgggggttccttggatgttgaaataaatactctttctttcagctgatgaaatttagatggcattggcaggctcaagcccagcttcacagcagagaggagagatttaagatctagggtttgatattccctgccactaggttatgctttaattcctccaggtcctctgaatgatactggatttataagaacactaaataacaccactgggctaaatcccaaagattgaaaaaggcaaacttaagtctgtaactaggatgactatttccttcacatcataaaagatgatacatattctttccaatgcctccccacttctttgaaaatgaaattgacacggatcatgagcaaatggcctacacagactctagacacccctcctccaaaacgcctcttaaagacacagccgttctgtgacagaatcttttacttgaggccaccagtcctctggcagggtaaaatacacccaacagaatacggatggctgatagtgctcccagaatgactgctacccccggattccctattgacatctgccaaacgactgtgcttactctaaacttacgggccttaagaagaccaaaatgttatttcttttagaaccatatttagcagctgttttgtttggtttcagccctaactgacaagcatatgcttacaaaagcaaaacagaacaaagaaaacaggaacagtaggagaactctccacatttatcttgaggcttcaggcttttcaacatcatcttcgaaagtacagcattaggaaactgtgctgactcaacaacccccagattctagtttatgctgcactcacagccaggcaagttccctcaaaggtaattttttactttaacttcccctcttctaaagcagtagaggtttgcagagtcaaaggtcttgctttacacagtaagatttatttaatccctgactgctacctggcaccctccctcgccacctactgtgtgttatacactgtccaaggtagaggcagtggggtacatggcccctgcttcatggtgcttccaatctaaggaaggaagcagacatgagcaacttactacacgtacatagtgattagatcatcataacgacaagcagcatatgagaaaaggtgctccaagagtattgatccaggagatctggaatatagcccagaagcatatcttcattaacctgctggcccaaagaagtcatctcaactggaatagataattcaagtaaaaaacataaatatatacagatagatagatagatgatagatagatagatagatagatagatagatagatagatagatagatgagagagatatggctataggtaggtaaaatactgattgttgatttttcttacttgatcatcagtgtaggacaaattaaactatgcaaacctatcacaggactggtccaaaacaattagggttcaagtctggattccactccttactagagttctttcacccctcatattccagttttcttcatctgtaatttgggaaagtgccctttggcctgcatttttacaatgtcgcatcctgcgtatgaatgttctaggtaactccccagctccctgtgtcaagcatcgtcttttgggaagggctgtcctgagtgtaggctgattccaggacacaaactgctccgatagagctgttcctggctagtgttggtatcctcttactaataccagctcctcaatgatcagctggctactggcagaacacagccaaacctccaggaactaaccctcgatactggtagcttccagtttggctttcatctctcagaacagggagactggagcctcctcacctcctgtttggtttgcagtctgcttagtttcacctgctaatgtgcagcagccagcagtgacactgctttagatcaccctccccgctcagctgcttcactcaagaccctgcagctccagcctgtcctcacaaagtcggcctttagaactggatttgaaacatcactcctcggattaatcactgcaaaaccttaagctatacaataagctataataggcattatcgttgtcattgggataggccatagcctaaatgcttttcatacattttcatatttcttccttatgcaacctgagaaataggtattactaaccccaattttcagatgataaaactaaggcgtcaaggaattaagtaacttgcccaagattaaacagtaagtggtagagacagcagccaagaccagactgtaaagtaaaggtaaaaatacctgtcatggaagatggttctgagaatccaaaacaacatatataaagcatttagcacaatgcatggcagtgcttaataaataatggctacagacatactgctcttgctggtggtattaagagaagtttcccaaggtgatgacaacattggttcatagtagagccaggattcaaatccaggtattttgaatccaagtccattattactcatttctctacaaatggccaatgctgaaattaacctggggttacggggatgctgaaggccttgtgggttaacaatagagccagagaatgggcagtgacctcaggacaggaaaccacaatgagccaaatggctgggagcatagaagttttctataccatggttgcttggtgtccctgcctcttatcagagccagaagccccagagagggagagcaaacaggctctcagatttctatctaaagctagtttctttttttcctactttgccattagctaggatgaatgctaattactttaagctaaccaattaattgacagtgagaggcggtatagcataatagtgaaaaccacagactctacagccaaaagcctgaatcgaatcccagcttcaccattttctagccatatgactttgggcatgttatttaatctttctatgcctgtttcttcaactataaaatactgataatggtagtacccactttgctggattacttgatataataattaatatatataaaatgtgtaaagcaacatctagcatattgtaagtgcttaaaaagtgttcgctaaaaattctttactcaagaaagaataatttctttactccaagaatgaataactcttattggttttgtccactgcagtatctccaatacctcgatcatgactgggacatcagagatattcaataaatattatctggatggagcaagtcctcacatcaccacttcttccaccgacagccacaatgcggtaaggtctgtgacatttgcagcgaggatttctgagatcatatcaataaaatatctctacccattttacagaagagcaaagagaggcccagacaggctctatatacttatgcagttatagatttctccagcaagatagtttaggtgatttatctgaggtcttatcctagttagtggcagagttaaatgaagacctatgtcttttgacttctagtttttccttctgtttgatttcaccctttagtaaaccgatggaatcacccattgcctttcaaaaagtggacctggaaaggaaggaaacagggacagtaggtaggatgggcaggccctgctgttcttttgcaaaatctaggtagttgggttaagaaatcgatttcattcatttccagaaatgatgtaagaagatttagtgcacatggccagtttgacagtccatttagtaggtcacatgcatatatatcagcataaaagataaataatattttcaaaatatatttttctcggttcacagacttagcatattcatactcacagttagctcagttcaaaattatttccttacagatgaaaacaaataattctacataaattgattattgtctactagcttacattgcataaataagtatatacaactaagaatataaaactaaaaagagaacaatccaaggacttcttgtaacactgacttgaatattttttctgattttggtgcatagcacagctattttaatcctttgtcagctgctgggattcactggccagcccttctcatgcttcttgacctgaaattcccaagtcacgactacaaacctgcttgtgcacacaaggaatgcacaagccccaactgtgtgttcagagactgttttctaacacattcagagtcagagaaaggcacaccaactccataaggcaagttaagaaaactcttcagggtactaagccacaagacagatattggagaaggatagctctctccatcacctcctgtaatttttctcagctcttctaaaaaagtcttttaagaagcatacatgcaggccggacacagtggctcacgcctgtaatcccagcactttgggaggctgaggcgggcagatcacgaggtcaggagttcgagaccagcctgaccaacatggtgaaaccccatttctactaaaaatacaaaaattagctgggcgtggtggtacacgcctataatcccagctactcaggaggctgaggcaggagcatcgcttgaaccagggaggtggaggttgcagtgagctgagatcacgccactgcactccagcctgagcgacaaaagcgaaacttggtcaaaacacacacacacacacgcgcacacacacacacacacacacacacacacgcaagttgctttaaaggtcaatatgcacatgaccacccccaaccccagcccctgctcaacctggtcccttccctcccatcatcaggttgttgcagagattatacagctgtttgggaaaatgtatcatacagtttacaaagatttgcaaacatgggatccttccagacctgtcaggacagggtaactttccagtatttccagcaaaacgaggtggaaatgatgggaaccagactagcaaatattttggccttttgcctttttgaagatacttagatgaagaaaaagatagcaactgcaggagatggatttaaagacaagagctggttacctaaataattaagaaagaaagattaggaaacaattcaaggttctgttttggaagaagagccttaacgggaccattcccccagagatactcatttaccacctgcttacaacagaccaatgacacgttatttgcttgaaagaattttcaactgttcttcctacacctataagcaaccatgaagttgattacaggcagaggtgaaacttttaggtaaaagggacctaactctattctaagtctaataggagtatgaggccccctttaccagctgcctacctgtccccacccctcttcacaatacagtgagcttccttctttgccctttgcagagggaacctctgatgagggcaagagttgtgcacactgaaaggggcagggttaatgcctttcggccaagggcccaggacttttctatgagtagggaaatattggctggttgattagatcatctgttactctcccatttccagagaagggtgagatggcccagagccatgtaggaacagccaggagcccaataatagctacctggagcagggacctgtcatctggcagaggtacaaaccaatcttagtccatcacttggtgtcaccagtaatggtacagatggctgaccaataccaactcttataaatctcatacagatgttaataacagggcttcatttgcatctatttttttttcaagcttttatatctatggctaggccaccgtgaaggacatacaaatttatttgcttgcttattagttttgcaaggcagataacattttggaacgggggatttataccatctgttcaaggatctaaaagctttttggcagactcaagaagctaaagccagtccttttgtccctccagatttccatgggtgttgaatttccactgtcaaataagtttgggaacactaggttaaaaagattagcaggttaggggtttctttactgcaaggcctctcaaagcttttaatgtgttaatgtaccctgtgaatctccaagacagggcaaagcttttcatattttcctaacttgtctggccacagaacactccttaaggaagctttgtatctcctctaagcactgatattctgcagagcatagaatggaaaatgacagtgtatagagcaatcttttctgtgtcattcctacttaactaaagcttgcatcttaagttactgtaacagagatggatcaatgccacccaatattcattctccccttgctccttaacaaaaattccaattttatttgggaggaaatgcacccagctcaaaatctacatgcccttgtcccactgaagctaggaatgaatacatgactaaattctggccaatggtatgtaagcagaattactgtgtggggcattcagaagggctgcccaaatggagctgacttagctgggagaagggttcttctgtcttcctccctcctccttcctgctgcctggaatgcagatgtaatggctagaacactacagccatttctgatcctgaggtgaatttaagaatggaagccttatgctaagattgttatagcggaacaataaaatgatcctatggttctgacgatcatggagctaccatgctaccgctaagctgcctatgtctgaacttctttatcttgaaagagaaacaaacttctatcttccttaacccactaatattttgagttttctgtttgaagcagctgaaatctaattgatttactttgaagtttactgttcagatatttttattcatttatgtttaactaacattccttctttaaaggactcttctccattagccttttgctctttggtagaggtggcagtctctaaggttgttgaatacatcttttttttttttttttttttttgagacagtctcgctctgtcagccaggctggagggcagtggcatgatctcagctcactgcaacctccgtctcccgggctcaagcaattcttctgcctcagcctctgaagtagttaagattacaggcgtatgccaccatgctcagctaatttttgtatttttaggagagacagggtttcaccatgttggccaggctggtctcaaactcctgacctcaggtaatcccctcgcctcagcctcccaaagtgctgggattataggcatgagccaccgtgcccggcctgaataaatgttctatttctcctcctgctggcatgttataggatggcacttccctacccctcttgaagctggctggggccacatgatttactttggctaataaagtgtgcatggaagtgatgttccacttccagatggaatatgtgactgacagttcaaatcattgtgatgactgtggaagcatatgtggacatgatgcctccattagtctggtacttggatagctgatgaatggagtcctctactgacccactctaggcatgtggcatggtcgagaaataaactttagttatataaagcctctaagagtgttcattaccatatcctatcctactctactctgactgaaagaatagaaaagaccagaaactgatgataataataatcatattgtataatgctttgtaacttttgaaacaatatttgagaagaactgcttcacactgaatgtctccccatgccccagacattatgcagggtattttgcaaaggttattttatttcatctctgcatcaatcctgtgaagtagattgctcacaagagaaaaaaagcgaggctacaagagcctccaatgccaaaacatacattctcctcactgtctcccatgtgcaatatctgaaggcagctcccagaaacagtaaaatcccttccaaagctggctgatgatacagggggcaaggaaagaccagaatttttacaaggtgcctacgttcacaaggctgactacacctacatggcctaaaccagagcatgctggagcttgtggtctctgcaccccactgagggcaacagaattgcaagtcctcgactgctcttttttgagtgtctttgaactcaaaacctgctttttgagccactgtcaaggtaacctagcagctgagaataactaattgggcaacgttctctgactgctggcatgaacagttataatctcagcatcactgtggcaacctgactggaatgctggttattcacacaaagaaaaactggtctccattcagaccagaattgcattttgtctttgttccacttttcccattacaagttgctactgaaggaacaatgcttcttttaagaagaatgtgtattattggtctgtgcaaaagcagcattttcttagccaaaaaaaaatttggaaagggaggaaaaagtaatatgtcctatattgccaaaggcaaagagactattaagaaagctctatataaacaacagtaaaggtcatcttggggtaattctgtggcgtttcagccaggccacagaattctgtggagatctcaatggtgcaacatgggcaacagatgactaaaaactagattacattcaatcaaccagtgcacatttcctgagcacctacaatgtgctatcacagacactgtcctccaaatctcccagtggttccccggtctactctgctctcccatccaacctcagcctccctttaaagctacagcacacctctccccaggcatcagctacagcctccagctcaccattcccagaagatgttctgtacactcccgcattctgtgtccttgttccctttttgttcttgctatccaaaaagtccttttgtcccatctttgtcagtcaaagccttaccagtcttttgagatcagattcaaatcatagttcctacctaaggtcctcccattacactccattagagtaaattccacattaaagtacattccaaagatcgctttgaatgtatctgtcttactgcacttggaaggcaactctccagggagcaagatcagcatttgaataaggctttaccacttccagttgtgttatctttgaaaaatcacttaatctcttagagccaaagtctcttcacctataaacagcatgctactcagactgcacccatgaccatccaactcatctgggaaccttgttacaaatgcagaaatctgggccctgcccagacctactgcatcaggattaacattttaataagattcccaagttatcccaatgcatattaatggtaccaaagtattgataaaatctacccagcagagatatgatgagaatgaggggaaacatagaaaacatccaacggggagtctaatacataaagactctcactaaatgaggaaatgactacactttatatccaataaatgtttggttaagttgaactgtttggtgttttaaaggattcagatatttatggcatgagctggccctcaagtgacatgtcagattagtaaaaatagattaaaatacatgaaatataaatgaagagaagcaaaagaactgtgttttagaagagcacatgactgaaaatgacttcatcgtttataatttttctgacattgaacaaggccactaatattttttagcctttggtgtcttttcctatcaagtagaaataagaataaaggcagcctgcttgcctctcagagttgaactaaagttattctaaagttaaaatgagctaaagagaatgaaggaattttgccaaatacaaagaaatgattaagtcggtgtttatcaagtaacactaaaatacaacatacccatcacaaactgagctcacactcaaaggtggccaaacatgaagggcacacggaggtcaaaacggtacattaaggccactggtttgaggatggagttttagtggaaagaatgaagagtgagccaaaggggacaagtagctctgccttctcagtgggctgatgactgaggtatctactgctttgaaaatactgggataggagtgggaggggacaccagctgggccctagaagaaaaggaattcacagcaaacctggggccctctcagcctaggggttaagagagaaatcagaagggagtctcacgactgtcagggcagaggcctgagactagacggaggtgtgtggcagccactctgacgaggaacacagaggaaacatttgctggaggaacctccatcatccatttctcaagaaccctgctcaagaaaggagaaaggatggagtttgggatctctgctctaacaagtcagacaagcagaacataacataaatgcaaagagagttcagacaggcaggaaatcgatacaaactgacacagtcaagcggagctgaatggaaaaggtgggcaccaagctagactttaaaatacctgcaggatttgggtacacagacagagatatcagtagaggggataaacttgctttgttaatagtattattttaaaagaacacatgttaattgcatgtatcatttctgtcagaaatgataaaacaatcctatcacttataggacagcatatgcattcagcaaactttaaattatttctagaaatcaggattccgtaagcatttcataaggcaaatggatttcaagtattgaacacacatggctatgacaaaatggcagacatgcatgcgataaagaatataagccagtcatttttttgaacaaaatgctgtttgaggcctcacttctcccaggcaaatgaacaaatacataaatgactctgatgtaataacttgtttacatccgtattccccactcagctatgctcctgctccttccaaagctgaagctgggctccattcatgttaatatctttagctacatgcactgtacctaggctacagggggaccttcataaatgctggttaagtaaataattttaccaagatcaacaacaagaaaatatttataagttgttgtttactttttcttgtgaaataaataaataactcggagagagatgaatacatgtatcttcacatcattaaatataccttcctctgagagtaccagctgggtcccagagaatctgtgaagctgcattcaaccacggcatatctttttggaaagcctattttccataaaaactttggtgttcgtggtgttttttaatatgttaaattaaacatgaataagtttgtatcaagtttaaaaataaaacacaaagatgctaacaaatttctggtttgcagtggaggtttctcagtcagtccaccagaatctctagggtttccagtttcctcttctttacccacagggatgttttgataaagacattcagaagtgtattgctcacctataccatttatagccctaattttcaaacacaataaatgcttcttatttcacctctactcattcagaatttgcaattactgaaattagagctgaacagaagtttaattgtctattgtccatatagaatagatttcaagaaaagtaataacataaaaaaggaaatctcatttttaaaaatcttcagtcaagtatcattcacatccagtcacttgctaattacaattagacatctctatcaaagccagtgttctctgctaaaggtggtgttccaggacctctgttgaaaaactttgccactccagggtttctcagttattgtctaaacctaaaagggaataagattcttcaaaaattattattgtcttacctttcagcaatataaaatgtccctgctcctcccaggtctctggattagggaggtttttctgtgaggcaaataatagagcaattctattccttaaatagagagatggtcacactggtgctaattaaataagctgagcatgtttgctttgtgcacttttcagtacatattttacaatttaaaagtttgaaaaaataatttaatcattaagagggcagcttcaatttagaagaatgaggaaacagacataagcaacccaacaattaaactatcagttccctgttctaggagtggttcaaagttcagaaatgaaggcctacttgagaggcagtagaggtaagtgtcttttattagtgcagaaattctcactcttaattactgaattccactcagtcattaaccatactatagtgcaatgctaactacataatgctagtagatagagtgtctcctacattgagataccagtgtttgccagtgtgtgtaactaaagcaagcctacagccacatctccaaaacctgacatcggctcttacatcttccacattttgtttcaaatctttctagggatagttctttcaaaatccctctcatgtgcccttctcagtcactatactcaaatgcttttatgagataagaaacttaaggagtatgtgtctggggatatttttaggaagagatggattttgtgcagctgattattaagtcaaataatgaattaagaataatgacaacaattgaagtgaaaaatctgcgtcattacagtaatctttctctcttgaacagaactatttggcttaaatcaaagccacctgtaggattatgaatttcaaaccactaggagtgaggcatatgaagtttctaattagcactggccaggaaacattagttctcccctttgcggtatcttacaggtggggatagagtgattgtatgttctcaggagaaatttgcagttaaaatggcctagtggttcagaacttggactccaacagaactgaaataatgactgtactatcagaaaaatataggtgagcaaggagtgtggggggaggggacgggggggagcagatctttccaaagaaagattgctgccagtgaactaattgactatttaatgtgtttattttacttgaccatctccaggagtgatacaaaataattaaacagcctgtatgtattttggtgatttccatatatcctaaagtactcaatacaaagactggcctgggccagagctggcatgactgccctcagcttccagttctagtgccatcttatccctcctaatcaatttcctctgggcagagatgtccaacaaccaccacagaaaggcctggcttagaatcttatttttataaaacataacaacttcccattgacacacattattgaatagagatactcttctgaaaaggttaggggtctctaagaagtaatacaaagaacactttaaaatgtagtaacttacatatttttaaaattaggtataaaaagatgcaaagagcactggtcattgtagaaatcatttcagtttaaaattcaggtcctgccacgcattagctatgtgactgagcaatctatgttactttgttgagtttcctagtgtcttggggatgaactgtgtctcccacaaagggtgacttcttccctactgcttcagcactcacataggcatccttacacacacacactacctttgtgttctacttcaactgctttcagttagtctgttcacaaacaacttccttaaaaactgatttccatcttcaaatcagagtaagcatcgtgtacacaaagcccttcctaaatcccatttcctcctccccagcagagcttagttgcttctcctttgtgttctaacagtatttgactatagcacttgccatgtattgtaactatgtgtttaagtgcctaactccacctctagactgcaagctacttgaagtacatacagtttttgaatgttattggtatctctagttttttaacagtatcaaaactgacagtaagttctcagtgttacacaaaggagttgattaatagcagtgttcatttcttgtatacttactatgtgctaagcacttacatgcattttctgtaatcctgacatgaactctctaaggtggacattagtattttaattttatagaagagaaacctgaggccccaaaacaacaaataagtgattaaagtcaggatttgcccaatctccaatctgttcacaagggatctagcacaaccacctggtacttattaggtcctcaaaaatgccatcttttttcctactgcccagaaaacaatgggaatgtgacttctgcaatggaagtaccagaaactgtgtccgttggtgctggctaacactattacttagaaaattttgatacaaaaagctcatttcaccaagtctgtgtcagcaaccataaacagatttttcaattgcacattaataattcccaaaaatattttccgagtgcctgctctgtgccagttctgtactgtacactaaagatctatgaataaaaagtcaagaccccagtctcaagaagcagacaccacgaggtaccaacatttgtagagcacttgctatggaaactttagagcacctgggaggacataatcttaatggacagatgttacatgcccattaaacccatcattaggggatctatgaatcatttaacggaacatagagtagcctgttctgtgccatgtatgtggccacaggagattcttttaggaagataatgtcctccatttgccaatgtttgtgttaaaattgaagtgcagccagcccacaggggtactcctaccagcatgtacttaggggattgatcagggtttccaatgaaatggcaatatggcagccacatagtgaagcagagagcatcaagacataaaagccgttcattattgaaactttacaacaaattccctgacaacctttccctggagaagccccttgtttctgccaacccattacatctattttgaggctggcaacctgatgtgcctctgcacacaaccccaagaggcacccttcatatacaatacaacatgatgcaaatacatcttgattggttcctctggagctgtgtgacaaggtggtcctgactaccaaagtaattaaggttctcatgcaccttcagttgccaagccattatcaacacatttgattttcagggaacatgtgaggagacctctgagcctttgtggcacgaatttaccaaaggggagcaaagcctagtgagtgaggtgcctctttctgcccaaaagtgcaagtgcatgatcagccatatggaagagatcccgggtaattactctcggtactttcgtttagctattaaaatgccacccaactgtcaaaccttcactcagtgttaattactgccacaccgtgtttgaatgcagcacaagtaggactgaaagtagaaaataaataataactatgcaaggttacagcctctttttgtacctctggttgcagtaaccaccttcgatctctttttaaggcctttcgttctcaccgtcattccctcatggactgagcagttgtttacaaattgcaaatgcctatgaaaagcccctatttcacagggtctcgcacacagccactcaattaatggaactaaatgccttggttaggttcacagaagctgctgaataactgccatgctgcacttggcatttgcctccagaggaagaacatgatgctgggtgatgttggtgatctcacctcttggtacattagctttcagctgaaagttcaaggccatcaagctgcttctctgactggcagagagggtgcatattaacctcacacctatccttcatgagataactgtgctggcttattctgctcttggactggagctatattttatccagcagttcttaacctgtgcccatggatgttgtgaacctgctaaaactagatactatgctttgtgcatgtgtgatttataggaaagggagcccaaacactgatcatctgaaaggactctaatatctagaatcttaggtgacctttcaacggtccttcaacacaagctgggcaagtgtatattcacctccatttcataacagaataaacaaatgctgagctgtgacttgcctgagtgatctgagaataagttgaggcacttttccagtactaattaacatcttcccagaggatgcatctaccatttgtaatatgtgagatgcatttatctcacataaatcaccttcgctgggatgatttgtctttcatctagactgtaagcccaaaagacaaaaactatttttgtctgtcttatcatctccatgtgtgtgtgtaatagaggaacagtgtttgtaccgaaggggatcaatgtttgtcagtctaaaacatgccatgatggcataagaattattttgagctaaaggcaactgacaaacatcagatgtatataaagctgtctactccccttgtatctgcctaaagtcagggcataaattttcctcagtgaagatgttctctctttcctctcccataccaggaagaggaggcaactcttattgctgaagatggcactgacttcaatctgcataaacaaaattgactgtaataaatcttatctttcattagttttccccatatacttatcttcacataaataagtacccctagaagtccaaaacccctttcttttctcttgtcatattgccacaatttattgttctttgttaagatggtatatataagcccccaattctaaccacttccttaagttatatttctttgtgaacttccatgcatatgtatgtaattaaatctgttcttttctcttgttaatctgtcttttttcagttaacttgtaggcccccagtactgaatctaaaatagtggatgaaaaagtcttaccctttcctatagtatataacaataactgtgatcagtgaacagatgcaaaccaaccttcagtttccaaaaatatttatttctgttttctgtcacaagacacctgtaggacaattttttttgatgaccataagatgtaaaggacaatgcttagaaaaacctagacaccaagaaaaacctgctaatgtctgcaagaaaagaacttcataatccagaagttcccaaaactctataattgctgaagaataactagaattttaacaaattgctcaaaatctcctttcaagtcctcacaaaatcagctaattcattaaaaagaaattacattatatgccccattacatttcataggacactggagatggacacaggcactcaggaaatactgggaaatagggacagtgatacaaatgacaataagataaaacaataaggatccagagaatggcatttgaaacttgaaaactgtatattgaaaagggtgattccagaaatttaatctggtcacaatgtctaaactggtggctatgagaaaggggaggagagggatggagtcagcaagaccagataaaggcagaatgacataattaatgtgtagcactttcagcatatgaaaacagcacttccttcatcttcccaaagaccatcagcgttgatcatattttattattaagaaaatacaggctgggcacagtggctcggcctgaagtcccagcactttgggaggccaaagtgggtggatcacttgaggtcaggagttcgtgaccagcctggccaacatggcaaaaccctgactcaactaaaaatacaataatcagcagggtgtggtgggggatgcctgtaatcccagctactcaggaggctgagcaggagaatcacttgaacccagaaggtggaggctgcagtgagccgagatcgtgccattgcactccagcctgggtgacagaacgagattctgtctcaaaaaaaaaaaaaaaaagaaaagaaagaaagaaaatacagttatcatactgtattcagtgtattcaatgcatactttgtctcatcagtgaggaaattttcaactattttctgggcaaaaagagtaataatccttggtagtaataaccatttatctgaaagaaagcacttccacaagctttctgtcacattttaaaataaaaaaaaaatgagccttctccctttacaatgcaggcatttctaggaaccactgtaaaagggcccactttttcagtatgtctaagagcagacagcactttccaccacctgccttgcccactctctcctagctcagtgcactttctcaggttgcacaagtacgaacacatggagaatgcaaagaatctatctaagtttggcagtgcttgctgcattctgcctgtagaagtgcccccaaatggtgcaagctgaagcaaaacagccgcagaagcaaaatacaatctcgcggtcagtgcagacccagctgcccttgtctcttagacattcctggctggaatcccactgagcaaatatagggggaaaacagacaagaaaggccctagattcaggaaatacccagctgctgcaggagagagcagcttacaaacagcaatttccctttaaaagtgcccccaagggcagatctctaaattatccctcgatatttcttttcaatcatgccatgaccctaccactggtttttaaactcctcctcttgaaccatatgatggacctacaagcagccagtaggttctcaaacacagctttcactattaggcctgaaatccaaagggaataacgttaccctctcatagcatagtttcctcattcagccatttctcaaaccttttttctccaaaattcttgctatcaagagtgactgttaataccaacagaaggacaagccttcaaggaacacagtaactgatctctttcgtaattttcatttgtcaaactaagggaagctatacaacttagaaatcaaatgtcatgttcatttatcaggtatttattctattccaaatctacacaggacacggacagaaaagattcatgcattcttttgaccgatatttattaagtacttactgcaattcatcaagtctaaaatacatattttttcacattttgacatttctggaattgggatgcatctgaaaattaagattctggttttcttcttttagtatataaaataatatagcatcttacaatcaattgcacatgccatggacgaaatgcttaaaacttctcaaatgagtacagccatcttttcccttgaacttgtcctcctctttcaaatgcatcctcagaggctggtaccagagtaatttttatctggggcaaatcttgtcctgtgacccttccccctgtttgaaccagccaatgaattccctttacctatgggtaagcatggagtcagaggtccttcatgacatgtcccagaccaacactggcagctcatctccccttgtctcctgccaaattataaattttcctcaatataccaatttctctgaactcaatataacttttagaattctgctcaagtattgactacctgaaaactttctctgacacttctatccccaaggttgaagtaaatgtcaatcttttgaggtcccacagcctcctatgctttattatattattaccacactctaatttggggctcttgatctatgtcccccaaaagaccaagatctccacaaagggaaaggttgtgccttgcacatttctgatgaaaaaccccagggacactgcctggcatggagttgaagatcaaaacataattgaaaggatggatgaacaaaccttatgacatctcatcctcagttcataagacacctagcttttagagatcatcagcaaccaaacaggatttcaattcttgttactcttgggttttgtctaaaaaacaaatgggaattcaagaaaaattgtttcttagtttctttccattctataattttgttatttgtgctccactgaaaattacctgctattctatccatctggcattgatcaaatactgcctttgcctatgaagcacctttttaaaaatggattctcagattggcaaaacagtctcgcacctaagattcttgagctgtgtgtgtgttgcagggggaggagagaacatgtctaaaactccggggaaatacgtcatttgagagcacatatttggtttaattttatacctagaaaacaaatgctctctgcattataaactaaacaatatacggcttgataaggtgatcttggctgatggagaaagaaaaaacgattgagattctcaactggggaaaagacatgatatttttatgaagtttatcaaagggagatatgagttttagaagttcaggaaaaactggcacagtaaaagctaatatggcataatcgttaacagcagattctggcagtagacagacacggggtgaaattccggatctatccctcgctaactggctctttgattctgaacaatttacttaatctctccaagccttccttttgtcatcagtaaaacagggattatcaggcacacctcatagggtcattataggactcaaatcaaagattgcatataaagctcctctaaccgtgcttggcacttaacaggcccctcaaaaatggtcgcaattattacaactattaataacatctcttctccagttaaatacagagcctacattatatgtcccattacattgcataggacactggaaatggacacaggcactcaagaagtactaggaaataggcatggtgatgacaaatgacaataagataaaacagtaagtatccatagaaagacatttgatatttgaaaactgtatattgaaaagatatcttttctacgattaaccaggttttttagattacagttatttttaacttatgaaatacagataccatgagcatttgtgacatatgcgtgcagttcaaataataataaattgaacggagtgaacatccgtgtacccaccaccctgcttaggaaacttaggaaacagaacgttaccacttggaaatcatctgactgtctttccctgatgtaccctcctctcatagcccagggtaatgtcttgaattttatgtttctcgtgtttttcactccttgctttttaaaaaacaggtttattaagatataattcataaaccatacaatcatccaatcaaagtttacaagtcaatggtttttagtgtattctcagatatgtgcaaccatcaccaccataaattttaggacatttcatcgcctcaaaaagaaaccccataccctgtagctaccactcctcagacccctcatcctcccacccactgcccccccaaccctaagcaatcagtcatctactttctctacggagttctctgtcctggacattccataagaatgaaatcatacaatatgtgaccttttgtgactggcctctttcacttagcataatgttttgtaagttcattcacatagtagcatatatcattacttcattcctttttatggccaagcaacatgccattgtttggagacaccaaactttattcctccattcatcagttgatggacattgtattgtttctgtctttaggctattacaaataacgctgctatgaacatttgtgcacaactttttgtatagacatattttcatttcagttgggtacacaatacgtaggagtagaattgcctggttatatggcaattgtttaaccttttgagaagctgaactcaccagcttttatactgatctccaggtggcagaaagctaaaagtatgtcagtgacttatggtgctaaaccaacctattcagccaacagcaggccctcaatgccagtgaaaactcttcataagtagttacacatcaattattcataggtgtgcaaatcctatcttctaagaattgaaattttctagcagttaaagaaagccagtagcaagaagagaagacttagtagaaacaaggctcttccacttcctagccattctcagttgattcttttgactctcagactaccatttttaaggtatttttcatgttgattcagtctactgtgtctgtgttgacaacttcaatgatgaaaccactaaagatggaatataaaaatggactcatattgaagacctacagaaatatcaatgcattaggtacagacaattttttcagaccaatgacttccagcaagtatgtttataaaaattaaatctacttctcaccaagagtctgaattgccagaaatacactggcatgaagagaaagcaggcaaggggtagaaggaaagagattaaggagcagaagcttcatctgaaagcctctgaaatgtggcatctggaaaatctattcacaccctcacaaatcacttttggtctgatgtgccagtctctaaagcctttgatacaagagtgcgaagggcatctgtctctgattttcctactcaacacttgtcttgttttctacagtctgctacactccccttttgttagccacagacagattgatggacagagtgaggtgacggaccaaggagtacattattcacctttacattagctatgttggggggttaaaaagttggccaacacagtaacgcctctgaattttaacacagtatttctgaatgtctttgactcaagtaaactattgctcagagagatgtagactaggaggacctaggaagcagaaattctcagtatcctatcgtgactggaatgaaaacatgctgactgcccagctacccatgtgaactccacattcccctcatcttgaagtgaaattagttaagaacagagagaaaataaaacacctctttgtattgacaatcgaacttacaaaatgacaacttaccaaaaaaatttacatttgaaatatagagatatcactgtaatatgtttatatcttaaagaaaatgcatacacatatacagaggcttgtatattataatttcctaaaacccaaacacattcaggcaatccaaatacattagatattagtatgtagagtttatcaatgaaactatttctataatacaacatacacgctttttttcttttatgcttatttctgtggtctagatttacaacacttaccaaaataaacaaactaaaaccaaataataaaagaaactgctgtctaatatcccttggggaatctcaacatttttatcttattcttaaccacactgctggagaattcttagaccttagatatgaagtgatatttaatgaataagaaatgctggagaaagaaaatacaacaggctggtgatatgcatacttttaatttatgttggccaaaacacaattttcccatttactgattcttttcacaccagtcacagtaaatagcacagacttttgtagataccaaaataactgatgttttactattagcacttttcaaatcattcctccttagactgtcacctttttccagctcaaaacagacttcacaactgcaagtttccactgtgtagttccaacattgcaatattttccccaaagaggtgtgaaacaggtcagtatacagagctaatagcatcacatttttatttagggggaaaaatacatgttacgaaattgttgggatagcgtaaaagaacaccagcttctgtgtttttaagcaacttgggaatccatatcttctatttagtacctgcacagtagtgtttcacagagagattggctatctctaaacagctgacaaaggaatccaaactcctcttggtatggcccacacagcccttcacaatttgtacccagtccaactttccagctcagctcccattgtccttctactatgtaccaaatcagtgttacctaaactttttcataaggcacactgaggtaaatgaacaactgggctcaagccccaggaatgaaaggataactgtctatgcagccccatcacctggtatgtcactgaggtaggggcattctacctacattctacctatgggagtgtattcatggttcctttgacgtgtcatgtaaccatcgcaagtctgcagttttgcacacactattccctttccctggaacatttttcccctccgtacgaaagaaataattcttatttttcaagactcagctcagacttcacctctgcagcacaggtgttcttgccctctgctgcctccttagccccaagaatcagaggctctcctctctgtgctcccaggggacttctcacccacagtaggtcacttctctgtcttctacactgcaagtgagccccttgagagcttacttacttttctaacttcagaggtaagcacaatgtctgacaaattgtaggtgctccattgctgttctttgaaataattcagaatttctccaaagcatgcagagaatagagaaaattcaaaaccagtctctatcaaatagggaattattctgaagcatatgtgctcaatttcacctgtggcaggacttgccatttatggattcctggagaaatgctttgatgcctccttctgaaattcaacatgcagtctaaaagagctcaagtagatgcaaacaggagcaggcaaattcccttggaccctgagcctccctccctcccagaggcaggtttagctggaggccaaacaatcacaagagtgctggtcccacccagaaatccaacaatattcagcatctaaaaacatgtcctaaagaaatcaccagcaatgcacaagcaattctgctcaaggttattaaatgtagcattatttataagagtacaaataggaaacagcctaaatgttaaacaacagagacctagttaaataaattatgactatctcaatgctagagaatagtaggcaaccgataaaaaaattatgttgataagaattttttatggcaataaatattattaccaaaaaacaaaaaaggaataaacaacactatatacagtttgatccaaattttacttataaaaacatatatatgtgtgcttgcaaaagtaagaagactggaagaaaatatacgtgtttagtggcatgtatatctgagtgacattatagtgataaaaaatttattttattctccattctctttcagtattttccaagttttctgtagcaagtatgctttacttttgtatggaaaaatcaggaggtggggaagtaataaaaatcaaagcagaaaggagtaaaaagttattattgccgagctgttctactctgggctgcatacagctgtccaccaatgttctgggaagctggcccattgtcaggatcacaggacacagcaggagtaaggctctcacaggaatatacaccctgggtgccccagatctgccctagactcagagtggacccgggacctgatgggttttcttaaattggtagaaaccatactctgggcccacagttcccttgccatctaggacaaaaatctaagacctaaatctagttttctgaatttgatttgcaagagtttcaagaaatcatgccaaatttcccctggtgttctcattttcctcatagaaaatgctagattcaggccaggcacggtaggtcacacctgtaatcccaacactttgggaggccaaggcgagaggattgcttaagcccaggagtttgagaccagccgaggcagcatagtgagacctcatctctacaaaaaattttacaaaaaattggctgagcatggtagtgcattcctgtagtcccagatacttgggaggctaagattgaaggatcatttgggcccaggaggtcaaggctgcagtgagccatattgcaccactgcactccagcctgggcaacagagtgagaccctcctatctcacaataaataaataaataaataaataaagtgctagatccagaccccagccagaaagacatttcctccccaagaatattcttccacatcctcctttttgtaaatacagttccatattattcttaatgttgctgaaaaatattttttggaaacacttaacacatgaaagaaattaagcaggacaactaggagtggatggtgtcacaaagacaaggaaagagtctcctaagcaccatatgcccccaaagataccaagatgagacagatcccaaaagcgtccttcggatttggcttctactggtgctgatgatctctaccagattcagggaggactgaagtcagaataacaaagtggtgtgtatacctgagtgatgttataatctttctttaaggggtttgcctgggaatagcaggagaatcaggccagtgctcacagggttgagacaaacacatatctagttggaagctagtgaagaatacagggaaaagggggtcaatgaaaactgaggagagacaggaataatgagagcagatctagtcctgaagaaaacaaaaaaagaagaagctgggaaccagagctccatatttccttctctcctgaattttcatttaggagaggtgagggatcacccttgaatgaaagaggtactttgtcttctggaacctgacccagtgattcttaaccagggagcccatcagaatctcctgtggcaattttacagccaacacaggcttgggctcctcctcctcctcacctcaccagcagacctactgaacggtcctcttcaggacgaggactaggctgagttatttctaaaagctcccaggtaattaagatgcacaatgctgtctaacgatcactggttagaaaggaggaaagggtgatgatggtaggaaatagcttcataggtgtaagagcaggaaactgaggaaggagagggttcagggttctctcaactaggaggtaaggtcaagaagtagagggcttagggagcagtgaagtcttaaaatagtctctgtgcactgctcagaacaaggcatgtgggggcaggaggaggggcaacactttatcaaatgtctaggagcatcaaggtacatcgtggagtgatttttcccaggagggttcagaaatgtagaaagcaagtgagaagcagatggtcagattaatctatatgtgggagtttcagggggatttggcatgaaagagcaaggaagtaatttaatatcaacctcatagggctgttggaagaattaaataatgcatttaaacacagtccagtgcctgacacaaaatgagagctcaataaatgttagctgttattgtcattgctacaaccactgttgttatttatttctggaaccaagcaaagtgatcacgtctgtttcttaggaatctatcaaatagaagtcagcagttgcttctcaattaacagaggaaaaattcgaaagctatgtggggtgttaaacccctcaaacaagaaatgctaataatcatatatttctgtaggcttccattaacttagttttgaatagctagttgttgagcattcttgcaataatgactaacgataactggtaccacttttactataaatacagcagcacaaaagacttaagaaattgaatggaaaataatgctctctttagaaagcccatgtgaggctgtttaaggtaagacattctgaacctttattccattactgctgcctccatccattcaaaaaggatttgtggaagttggcaaagatgcatacaaaacaaaattaagaaaagaaagtaaggcaaccagtctaaagagaagtaaagggtaaggaaaaatgtattcggtgtccaatgcacaggcaaagaggtccctttcacaatgctagttgtgggtctcgaatttggctgtgaaccacctggcagtggactaaagagggaaacaggaacagtactcacagtttccaaaaccaagggaaatactgctattattgttaataaagtgtgaaaattttttccttcatagattgaccgtgatatagtgaacaatgtctataatatccttacatcaaggtttaatcacctgactaaaagatacccttcctccagcttcaaaaaaacatccttaacttctggtagaagagacatggtaccagaatcaaaggttagctctccaaaatttaggaattttttctatgttatttattagtccttatgttccatcaaagacagaatcattttgaagcatatccagctcaaataaattaatgttcccattttttggaggaaataagtttacatacttaaatatgacctgcataatcactcatctaacagtaaagtatatttttcaacccagaattattttgcccagccaaagtatttttaaaaattgtaggaacaccataaagacatgctcagatatgcactgtctaaaagttttccttcctttctctgaaagctactgaaaaatgtgctccatgaaaataagggagtaaacaaagaaagaggatccaggaaatgggagctagcacaaaaagggaaaaggatgacggtgaaaggaaatcccagtatggcaggcctagggcacagatagtccagcctggggctggtcagaggctccagaagaaatggccccaacaagatgaaacagatgaatagctgctgtggctaaatacgttaaagagaacagcccacacctggggaagagtgtagaactacactagtgatgagtacgctgaaaaccaagcaaacaagagcttttgtcttagaaaagggggtgaatggccgggcacggtggctcacgcctgtaatcccagcactttgggagacgaaggcaggcagattacctgagatcagaagttcgagatcagcctggctaacatggtgaaaccccgtctctactaaatatacaaaattagttgggcgtggtggcacacgcctgtaatcccagctactccagaggctgaggcaggagaatctcttaaacccgggaagcagaggttgcagtgagccgggatcgtgccactgcactccaacctgggcgacagtgagactccgtatcaaaaaaaaaaaaaaaaaaaaaagaaaagaaaagggggtgaatagaaatagatccatttgcttgcacaaggaaacaatggaagcataagaaactaataaagacagcaacttacaggagatggagaataatggagacagtagaactagaatagagtgaggttttttaaagtacactttctatgttgttttaatttctaaaccatgtgaaagtactacctgttcaaaatcaaataaaaataaagttctaagattgttttctgctaacagtgtccagaggctttacttgttcttttgacagcatcaactgctgacccacacttggctttctgtattgcacacatctatagagaattagaggcaaagaggtcacaggatatggctacagccttgaaaataaaatcagtgaagataagagaagtgggagaagcatcttcaatttatcaaagcatgaagtacagccacttgttttctagaaaaaatagtactggctatgtacctacagtataacccatataagtgtatagaaatcagatgtattaacaagttgtttttaatgggggctctatgagaattttgaccatgcagttcttcctcaaattcccctgtgcgttttgaggagtaaggatccctagccactgtccaccaaatgtcagtgtgactcctcagtcactgaggcaataaaaaatgttccctcctccacatttccagaagctcatactcccaactgagaaccactgtgaggaataagtaaaaaaattaaaaattaacatttgtcaatttttttccctatcactgccactaatttttatcagttcattaatttaatgaatctttataacacattcattaagaaatcatgaacaatctgatcttccaaatgcttgggtgttactaaagatagtttgtgccttgagtttgtttttttttttaaccgagctagagaaaatctgaggaatctagaatccctgccagccttcagtcaaagtcctgcttcacaactgcagagtatgcagtttaattttttttaagttcttatatattctctcattgacaaaggctaattacttctcttaagagtcatgtaagctcagcaaggaaaatactattttccccattttcacagatagggagtctaaaggtcagagcagtgaagtgatttttccaagctcataattgacagaacttggagcagaaaccagaacttctggttgtcagtctggcggtttctccactcagctgtgatgtttactctagacagtattttctctatgccaagcctataacacatcagcttgattcaaatctttaacacgatgattataaatttgaaacccagcatcttatttttaaactgacaggtcaactataatggtcctcaaaatggtacactttgaaaatcaataaaggtgactgagggttttacacaggttagcttgtgtggtcttcccaatagttcttctaggtagatacaatcattatccattttacagatgaggaaatgtaggcagagaaaggggtaagcaatgtgttacttaaggccacacactagtaagtaacagtgtggatttgaacgcaagcagtcaaactcaagtcggggaaaactcccagtagatttaactaagaaataaaccccccagaaaaactggcaggtggattgtttagataaacaatgaaatgtctctttagctctgtaaagaaaaccagcaacccctatgtaagtttttgatcaactggtaaaaatgacctcaaaatatagaaacaagcaagtaactgtccctctatcaaactaaataatattttaattgcctaagtagtgggcatttaataaatcatcaattttctattctattaataatatttctgtggaaacaagacaactctcaatcaccaaatctggtaaaaaaaaaaaaatcacaacaaaaatcatacagaggcaacacaccgagttaaacaacagcctggagaaaatagattcattttattcaacttcaaaagtgataagaagttgactccaattattctattccacataggaggttatgatgcttatgaccaatagccaatgcataagactgataattttctagtctaaaatttctacagagcatcccaaaattctattttcaaccaagtttaatctccagaagtaagagtatgatatcttggtaagaaacactatttaatataaaaattcatagtcatgaaataatttagtaagacaccaaaagggtcacagtcttacctcaaaaaccatgtgcatactgaaaagtagccaggttgagggcaagtaagaacttagggaaaagcctgaactatcaaagaaatcatctgtctaagtccccagaagaatcaacctctacagaggtaaaaatggaaagggcgggaggagatacagctataagtaaaactccatgtggcctatattctatgataatgtatgatcaatggtacaatataggtaggtaagcatatatggatctataacaccagaaaaacaaacacatgttgagttaataattagatatctaatgatcaaagaagagctagaagtgaaaaaaaaaaccagagcacctacttaccatgggttcagtggtggtccctgttgccagcacacattccgtaatctcggaatcctgtggctagtccactctactgcctccctagatgatggaactctgatgccatggcacattgcaggagctacctagtcatatcaacagagttacagactcaggaattgagaagaacccagagctcggaggccatgcagcagggcaccctccatattgagagcaaacaccatttggggtttggggtttatttatttatttttttttaagacagggcctcacactgtcacccagactggagtacagtggcacaattatagcttactgtaaccgtgagctcccaggctcaagccatcctcctgcctcagcctcctgagtagccaggactacaggcatgcactaccacaccagttattattatctcttatttttctggtagagacaggatctcactgttgcccaggctggacgtgaagtcctggcctcaggtgatcttcccacctgggcctcccaagttgctgggattacaggcgtgagccacctcacccacccagcaaacacagttttgaaagactttctagtaaagagcccaagaattaactgcccagagaaagaggatgtgtccccatcttacagatggccagtagaggcacccagaagtgtgatattcctgaaatcactgattcagtactgaacatctaagataacacagcgatttgctgacaaagatcacagtagactctgtgagactgtaccttgaagaaagaagggaagaataggggcagagaaggcccctcaggcctgcctggggaagtgggggaatgggagtgaggagaggcagaggggacaggaagaagcccctccagcagtaatcaggggagagaatggtcaagaggagcttgaaggacactgagagctggggactggggtccggtggttctccactggtatgtgggtgaaagtggagaaggaaaagtcgaaggagctgatgagctaaagaaatggcggaaggaagtagaagagaactggggaggccttctgacagaggtcagtgctggaaaaggggaaggtgggcacaagagatgatgacaatcttggtagaaacatcatacagaaaatgcaaacatccatctagatgaccttcagtgatggtaagattctattaaccttccagagttatccgctccaaatttagaaacgttttatttgtaaaatagaaattgccttgttgctttggtccatttcttctcattttaattggaatggggttggaggacagttggttaccactattaaaatgatgtgttttcactgggctcatagctctttaaacagactgagggataaatactctcccagcccctgttctaagttggcagacagacaggaggggccactaagacaacacctaccctctgcaaatcagcaccagacaaacactttagttggacagcagaaattatatctccattttccagaggaacagaaacatctaaaagtttaaatttaatctaacaagtattttgaagttcttgctacatgcaaggccaccctaagtttatttgtgacacgacagcatcttccactatgaatgaaacacacacaagaatctcagagtttcaacaggcgcccatctatctcatcaggctcattcaagaatcagaagtatcatttaacagtccagaaaaaaagacattcaggtgcctcgtggctgcttcccgtcttcaatcccttcagcaatcatggttctgagtcagctttcataacccacaatgacacatctatctgaggcacacattctgagataataatgtccataaatggctgaagataaaagaaaaaaatcataagacagtataatgggaatcataagacagtataatgggactcataacaagatataatttccataaaaaaccattttggtggcagcttcttctaaaaaaggtgatgaaagtaaatataacatctctcacataatgtttatgttctgtaccttgtatagattctatgtctttattaaataaatgaaaagaaaaaaagtccacatagacaaataaaataccacattagggcttttttttcccccgctcaatctggaaaattttgcaaaaaaggatcttttatttatggaagccctgactttcaaatcttatttaataagcttttaggaaatgaaagataccggtggctcatttagccatgaagggaagctgcaacaggagccagggcctagacttgccaaatgaaggtggctggaggaaagggctatccgattcattccgccatgaaggacttttacttagggtcaggtgaccaagattctctatgcaggtcagaagacatcagaaagcaggccgatctggatccaattcagcatctggcatcattgactgcctcggccatgtcacttaatcctcctgagcctcaattccctcaatggtgagataagcttgtttatgggactacccacctcagtaggttgttgtgatgattaaatgaagtgccatgctaaagggcctgatacctaccagacatacaacacaaaccaccctctttcacctcttcttattttccctctggctgaaccccagtggtatggcaagctaagcgtctctaaatatcaggcgcctcaactgcaaactgacaaaggataaagtatgcgaaagctttaaatcgctatgcaaatgttaggagatattgttattagtgccaatcggtacacctcactcgcaactgcacatcagggaataagagtaaaaagcatctctcagggagtttctttctaccccacctgtatactgctaactataaagcatagttcagcccccttcagggacactaatataaaagtgtccctgaggggggatgaactatgttttatagttattttctttttcattttgtgcatttaattaatgcttttatttctgtgctcatactcttgggtaaaatttgagaaaaccagaattggaaatgctaaagacaaatattagcaacaagcaacttgatatttgcatatccttgcaaagatccaaaaggagctgaatatgtggaaaacaggtagtaagataaagaaaaacaagtgttaagaacaaaagttctgtgagtttctctggggtgaaacttgcctaacaatcttcaacacccagcaaagtgtccggcacatggaaggtatttgataaacgatatttacaccatctgtaggaacaacgtgacctcagtctaccactgaccactaataaaaagataagcagaaaaccaaacctgaaaaatgaatattactctagctgatatgtgtttctattgactaatttattgatttttagaatggccatgggtacactacaggggtatatggtcttcaactcccaactatgtaaactctgaattccaactttaaattgttcaaaataaacagaccaaaacaaggcctctataacccccattacctgtattgttgagatgatgagtttgggcagaaacaaagcctggaatgaaacctcattcccgtcctccccagacaccacatacatcacatgggtgtcagagaatcctgtgcatctaatcattttcaattgtcatttcatctaggatgccaaatgttaaataatcaagactaaattttctctctgtctctctccatctttagtgcaagcagtatattatgggttaccatactattcttaatttctaatcatttttagtgtcttttctgccaatttgtaggcttttcctacctatcccagtgtttcttctggcctatgcaacacttgctttgcatgtatattatgccagagaaagggaaatttatattcaccacaattttgtacaaacaagcaaggcaaagttaaataaaaattagaattcagaagagaagcagcaatttatacagggttctttggccctctgccaatcctaaaagaactttgataacatcaaactacagaggtcccagcacctatctgtaaaaagagaaatacacaattctcagtactcaaaagcatcttctggtttgctatgctagaaaacaaaccaccctaaaacttagtggctttaagtagtaattttattatctttcatggttctagtagcttttactttgcagctgaagctggaatgatctgaaggctttttcactcacatgtctggcaccttcctgagaaggctggctgacacctctctccatacagcctttctggatgagtatcttcagcttcctcacagcatggaggtctcagagtaatcagctccttgcatggcagctggtttctcaggatatgaatgaaggctgcagtctctttaagactttgcctgggctgggcgcattggctcacgcctgtaatcccagcactttgggaggcggaggcgggcggatcacaaggtcaggagatcgagaccatcctggctaacacggtgaaaccccgtctctactaaaaatacaaaaaattggccaggcgtggtggcaggagcctgtagtcccagctactcgggaggctgaggcaggagaatggcatgaacccgggaggtggagcttgcagtgagtcgagatcgcgccactgcactccagcctgggcgacagagcaagactccatctcaaaaaaaaaaaaaaaaaaaaaaaaagactttgcctggaaaattggtagagactcatttctgccatattttatatgtcaaatcagtcatcaaacccactcagatgcaaggggaaggaggtatagaccccacttctcaacaggagaattgaattggaagccaccattaatccactacactcagattgccttgcatggtctgcatcacaaacagggctaatggcagaatgagccccagtggatcagatttgtgcacatgtagatgtccactcctgtaaaacatcaataatctttttttttttttttttagagacagggcctcacgctgtgtcacccaggctggagtgcagtggcatgatatagctcattgcagcctcgaatgcctgaggtcaagcaatcctcccaccttagcctctcaaggagctgggactacaggcatataccatcatgcctggctaatttttcattttttaatttttttgtaaagataaggtcttgctctgttgaccaggctggctgagaaatcataatcttaatgttgggagattgaaagtggtgctggtcaactgtgctagttaattatttagtgtgttttcatttcactgctatcttccaagtttggggaatttattagaaaaaattaaaaaagagttgcctttgatcactggcaatcatcaaatatataaatttattgcatgtattttataatgtcatctgggtaaaaaaaaaagctattaatattttcatggaggtgcaacaggtttaattccaaattttggtcaccgaaagacttcatggctcacctttttatactggtcttccaagcggaaatgaatagataattatgcagtcctggacatacagatttaattcctgttgtgaatattcattcagatgagcaggaaaacttcaggttattttaaatcaggatgagaaatcaatactactagtaccaaagaatatatctgcatataaaactgctcattaaagtcaggcaaggaagacatagctcccggaaagccccacttagaaattacaccgaagctgatccccgccagcaacttgttaatgaatatctctggtgttctaggccctagaagaacacacaaaggatggggcgagaagttttccattttagacggtgaccaagccctgtaggaactggttctgtctgaatcctttctttacccattcctgatgactgcttggtggcttttttgccttgggtgcctgctcttatagcaggtcttcaagcctgctgaggggcttcttgagaaacttcaaaccatcctacttgagttgtccttgctctgcaaagtccaaaaacaaggtatggccagtctaataaccctttctcttggagaagaggcagttcgtccctgttcaagagaaggcaggaatgacaggcagacatcaagttctttcttgcttaaccaacattaggcagacagggtccaccccagagcagcagtgtgtgatcactgttgacaggtacacagagaggaagaggtgagcagcagcaacgtggaaactgggttaagaaaaccccagggaaaaaatagatagctaattagagttttcaaattaatgtgcacaaactgaaatgaattttcaaagatgttcctcctttccttgtgccaaaatttaagtctttttctgaggtccagaatgttacagccaacagaacaacttggtgatagaaagcaatcatttttaaaaatcataaaagagattaattgagcccttataatgtgccaggtgagtactgcgactatcagcattttacagatgaggaaaatgagacacaaataactttaataacctgcccaagagcacttagaaagcaagagctaacacccaagtttatactcctaaccaccacacaaagtatagaagaaggagcagggcttttctgactaaacaagactgatatctaagtctaactctgccaattactgtgctagatatgtgactttagtttctaaactttctgagcttcagtttccttgccagcaaaatagggataataccatctaattcttataattggttgctgtgaactctcagaatgtaggttttcaatcaatggtaactatttttttgttatgcagaccagagggaacacagccaagctagcaaaaatgaaacacaagaatgggaaggaaacctggaagcatcaggaacatgcacacctcattttctgccaagcaggcaaactataccttggcgagaatttcctctccagagcctcaactcctctttttaaacacggaatgggcataattctgggagattttgcatatgcagtattcataactcagggaaacaatgtgcattttccttttatttttaactagagatacacaaatacatgataatatcatatgcgcatacatatttttacttacattcaatcttttgcaactctaatgggtccttaaatctgattccaaattaagtccttcagacacggctctgattaaataactagctggtttcagagccatctgaggattttttatgctaataggataaaatccagtctctttggcctaccttcctctacctttcacagtaatttccattctaatgctatcacacacacatatcccaccccatgcctcatcaggaactcttctataaaggacaaggcctctctgcctgcttgtccctgaacataaacatcttgctcattcccacctctgcatctttgcactggccggatcctctcagcatcacccactggctcatttcctccagttcaagtcctaccagtctgttaagaccctgctaaaggacctcctcttccagcagacctcccatgaccaatttggcccccattaatccattttgtttttctactgaattcctacctgtgcagacttttcagtttcatttctacataatttactactatgtaactttccttagagaaaaatcctccctcctcaaggatactatatgcaacttgagagagcacatggttaagagtacaggttcgcagtcaggcagatctgaagtcaaatcccagccttgccatattctagctgtatgacctggaggaagctacttaacttctccaaatcgtagttccttctctgtcaaatgggattataattgtagttatctcacattgtttgaaggggggattcatgcctggtaatatataagtgctcaataatgtcagctataattattatcactacccatttctcacacgtttttaatcccccacagcaccagctatctattaataatctatctacctatccatctatccatccatccacccatttatgttagagactcgatgaatctttaccaattgcctaacttagacgtaccaatccttctcaaatttccacttctccaagaagcacaaagctgtttctactttattaagccagcatcgaaactcaagattccccagatagggtctcacacagagcatgctgatttccaggagctttaaatgggaatgaaaagtgatcattcccttagttcagatatgctggtttgaagaatagctgagtaattcatgaggttctttcaggtgcattgatcagattctgctctttaagaagcattgtaccttgaagtaactatttgtcattccccttccaaatgagagctagataatagactgcatctgtttagcaaaactataacaaaggtctaaatgataataataccttagacctgctggatgcatcatagtttataaagcacgttcatacacatccttcatcgcatgcttccagcagccccaatcagataaccagggggtttatctcagtgtgctaagtgggactgctcaggctggagaaggttcaagagctttcccacaggccagttcattgattcagatcttccaactcctacttcagtgttcattttatggcaccacaggatttaaaactattcgcatatctttacaaagagatacccagctggaaagtgtgtaacccactgctaatttgtgttttggttaaagtatctatagtatcaccttggagatataatgcaaagcaaatctgtcaaatggtatttaatgcagttctatactacctgagactaagtggaagacctcagttgaaactctgtttttaaactagccattttcagtctttcgagcctgttttcctagaagtagagtaggagtacacagcatcagcctgctgggattccttgataccagactcagcctctactgtacttggacagtcttccttggtccagttttccaccagttttctaccaggctcccccttccttactgccctccagttgcccaacccgctgcctggctctttctcagacatacagagtatgtaccatctcagtacctattcatgggtggttctcagtgcatggcctgctccctttccttattcacatttctgcacaaatatcacctcctcagagaggtcctcaaaccatctaatcttattaacaaccccagacgcactctgcaaccactttccctactgtttcatcatagcacttaaccactactagacattttacaaatgtttcatctatttataactggtcttcagcactggaatgtaagatctaggagggcagggctttgtattgctcaccactgtatcatcagcacttgaaaaggtgactgacaataggaagctcccaataagtacctattgcataaaggaatgcagcctataaatttccctgtttaaaatctctacctcttccaatttgaaaagattcttatacatgaagccaaaagaacaaaaacaaatctcacaactaagataaatgcacaaaaaaaattagtgcatggatgggacaaagaacaagtgtacagaacccctaggattggaacagccatgactccaacaactgttacaatagttacatcactggacctaatgccaatcagttgattaaaaaaaaattagctgggcacgatgactcaagcctctaatcccagcactttgggatgtagaggcgggcagatcacctgaggtcaggagtttgaaatcagcctggccaacatggtgaaaccctgtctctactaaaaatacaaaaattagccaggcgtggtggctcatgcctgtaatcccagctactcgggaagctgaggcaggagaatcacttgaacctgggaggcagaggtttagctgagatcacaccactgcactccagcctgggtgacagagcgagactgtctcaaaaaaaaaaaaaaaaaaaaaaaagaaagaaaaagaaagaaaggaagaaaaagaaaaagaaagaaagaaaaaattaatgaccaacattccccttctaccccccaggcaagaggtctctcgttgcctaaggcaatttcatcgcatgcctcagagtaagcaaaaactgacagataaatgtcctaggctatctttttgagaagaaggtccaagttatttcctggatttttgcagatatgacagtaaattggcaactgagggaataacaacctgacatcatgtgcccctaatctgatacaattagagctactcatcatcagccatgaaatgttcttgctaaaaatatgtaatctgaatgtaatcatgaggaaatcatcacatatccggaatgtagggcattctacgagacaactggacaggtctcttcaaaaatgttagtatcgggaagaacaaataagatgtagaggctctactagattaagaaaaaaagactcagttggatcctggattgcagggggaagctagaaaatcgaaaaactagagaaagctgaatatggatggcatagtttacaaaagcttcatcagctacatccatttactctacaatatttaaagccaatgtccaatttatcactattcacccctgcaagtaatcattaagcattttccatatatatcatgtccttctccaatcacatacatctcatcacagtaatatctatatcctgaattcagcagggcttagcctccacagggcatctttaatactaattggaggagacaggctttataaatccttatttacaagatgattatgaaaactatatttcctaggcctgtcctttacgcttctattattctctctctttctttctcttgccaataaagttcttattaaatgctgcttcagccactaaattgtaaattccctggcagtagaaatgatacctggttaatctttgcatttctaagaagcaaacaatggcttacatagagtacatagctcataaatgggttgttgaattttcgaaattactgtactttaatttagaccacataatgactatttatttgcttcaatttttaaatgaccctgaatgtctctgtgctacaaaatgtactgaggcactgtacatctttcagattttggaacttgcattcagttgccaataattttatatatttcatgaaatgtttaacaataaaactactctttgcatctcaaaatatgttttgaagaaattatgaaatcaagatgttctttcaatgtataaaatattcaataagtgactcaataaattagtagcatatcttatttgaaactgagatgccattaagagcatttagtaagctgttttgaatactcttatctatctctgctaacaaaggcttgtttcaccaagtaacttgggaagtcatcccagtatcatgatttatacacctctccccattcatactaaatgcatcttcactaaccctcttcaatgagaacttttatagttacttatttctttagaacttattgaattgattctcgtattgtgaaaggtattataacttatagttataaaaaaaagttaaaaatcatttaacttttgacttctcatctcatgcctagctttttaaatttccatttctatttgtgaatcttgacatctgtaagcctcctggatcatcaggctctgagacagtcacattctactttgctgaaatcagattgctcactgaacttcaataagtatgtttctttaatacttactagcacccttttgtgacaatccccaagcccaccacctcactgggacttcaccccttcctataatcaaagggctttgaaagacaagctttctctaaggctgcatggcatttcccaaagaattaccatgacctagttttgaactccagatagacttcagccagtgggaaacaatatacgaagcatctttatttcagcaactgagcctcattccgaagaactgctccctctctgagaggttaccccagtggaaaatactgcctgagagaaaaagagattacatgtgtggtctgggtccagccatgacccagctgtacaatcctgggaagtgagtcagtctctgaactttgatttcctcatctttaaaattaaacagtgagactaggtcacctctcacttgccttccagttctaagattctataattccatcgagtgttcctatgtggagcagaaaggggaaacataattatcaaatttcaaaaatacggcataaaccctttggtaattcttctgtattctgctacctctacgtattttgagtaccctggcaacttccataaggacttacaaaaccttagagactaaaacgtgggccaaaccgtatgacccagcaattctactcctgagaaatgaaaatgtatgtacacataaaaagttgtacacagatgttcatagcagcattattcataatagcccaaaggtagaaacaacccaaatgtccatcaactgatgaatagataaacaacatttacagtctccacacagtgaaatattatttggtcattaaaaggagtgaaatactcatacatgctactacaaggatgaaccttgaaaacaatctaaatgaaaaaagtcagtcacaagattatatgatttcacttgtatgaaatttccagaacagagaaatctacagggacagaaagtagattagtggttgctttagggtggcgtagggagaatgaggggatgggagatcatagccaaatgtccatcagttgatgaatagataaacaagattggtatatccatacaatggtatattattcagccataaaaaataataaactactaatacctggtaggtattagtctgctagagttaccataacaaaataccacagactgggtggcttaaactacagaactttactgtcttacagtaatctcagatcgtggtccagctagaaatcccagattgaggtccagcagggtcagtttctggtgagggttctctttctggcttgcaaatggtcacctttccactgtgtccccatatggcagagagagagcaagctctttggtgtctcttcttataagtatattaatcctaccagattagggcccaagcttttgattctatttaaccattatcacttcttcaaagggcccgtctccaaatacagtcacactgaaggttagggcttcaacatatgaatttacaggggatacaaacattcattttataacatgtaacaacgtggacaaaacctgaaaacattatggtatgtgaaagaagccagtcacaaagcaccacatattgtataaatctacttagagtaaatgtccataatgggaaaatccgtaaagacagaaagtagattagtgattgtttagggctgggatggggatagagttgaaggaaatgtggaatgatgtttcttttggaggtgacaaaaatgttctaaaattgactgtactgatggttgcacagctctgtgaatatacaaaaatccattgaattgaatacttcaaatgggtgaattgtattctccatcacaagaaaactgtttaaaaaataataaacaaatagacaaggctcaagatgattgcctaaggatgaaaaaacaaagagcttttgaaggaagtcctgggctcagatcccagtgctcccactcattagctgtgtaaccttgggccagtctctgaacctccagttcctttactctgtgacgtggggagagcatggcaattgttctcagttggtgtgaaaatgaaacgaggtaatgcacagtgcccgacaagtatcctaagcacttaataactaatggtcattgttgaatattattagcatttcatcagaagaatagcccatctgttttttgaactgaattgatttcaaagctcaggcactgaatttgaccacaagtttttagtggctactgcagaagtggaagcactcatttttcaatatccaacaacagagtcagtgccacttacctataagcttgctgttctatgaacatgtttgtgactcgagaagaggcatgtcactaaaaccaagatggctttttagcatctttagtcaagggagataccagtgtccaagtgatcaaactatttcatgcccggagctgacagtcaatatttgctgactgatcgacttagccatgcctgacttatgagggtttttatttcaaccgatgtttcattaagtgttggtaagacaggcccaactgtccctgggcctctggagccttttgggatatgcagaagaaacagagttggtccctgcctataggagtttgtattcaagcatctagtcctaaactgatttttaagtttatgtttactttaatgttaccactattccaactctccatgtgaataaacaataaaactgctcagtacatgaaggcaagcagtaaaaaggagtttttttacactcaaggtaggcccacctctccagcacttctgaggcccagttccaatccaaaaccagtggaaagaactctgggccaaatgctgaggacatgagagttctattcccagctataccacagaatagctatgagtgcaagactcctcctttatctgtagagaatatgtggatgcctgaaaccaagaatactactgaaccctatatacacaatttttttcctatactacatacctatggtaaagtttaacttataaattaagcacaatgtgagattagtagcaataactaataataaaatagaacaattataacaatctgccagcatcactactcttgcactttggggccattattaaataaaataagggttactcgaacgcaagcactgcaagactgcaacagtcaatctggtctgacaaccaagagagctactaagtagactaaagggagggcagcatctattgtgtggatacactagacaagggcctgattcacgtcctgggcagacagagtgggacagcttgagatttcatcatgctactcagaacgatggacaatttaaaacttatgaactgtttatttatggaattttccatttaatattttcagatcgtggttgactgtgagtaactgaaactgtggaaaatgaacccacagataagggggactacagtacaaatcctacccttttgtactgcttccatcactaagatatgaaagaccaggttagacagtaaactaagtctctctatcacctagaccaaaaaatgcatattagttctacataaactaagtgcctttgatagttctagttctcactgtaatttaataaactggcacaatgttctaaacaagatgtagaaactgccttccactccctgcagacacacacacacatgcacataccccagaaaatacaaagtgaggtccctgagcctgactggcagaactgacccattgtgataaattcacccatctgaaatgagtcctcttgggaaagagtctaccagcttatcctctagaattcacgcccctctttccatagccccttcatgggcctgtgtataagggagctgtgatccaacttggatacatactttccttctgaagtcatggtaccaccagcccttttgggtgtgggtgcctgtggttgtacactgtagttctcagctatttaaaaatatatattcctgaaatttgttcattctcacctccagctgtactccaaccataagataacatatgaagatgctaacctcggagccaggctggtttgctggataaaaagcagagacattgaataagaagacctagctctgctcctgattagttgtgtaatttttttttttttttttttttttttgagatgaagtctggctctgtcacccaggctggactacaatggcgcaatctcagctcactgcaacctccgcctcctaggttcaagcaattatcctgcctcagcctcccgagtagctgggactacaggtgcgtgacatcaagcctggataatttttgtatttttagtagagacggggtttcaccatgttggccaggctggtctcaaactcctggcctcgtgatctgcccgccttggcctcccaaattgctgagattacaggtgtgacctaccacgcccgaccagttgtgtaaatgagacttaacttttctgtgctttgtctgtaaataaagacaacaaataatattattgtgacactgaattaaataacatgattaatacagaaggaactagcaatgtgtccaccaattacagaacatcctgtaaagtcagtttgactaaaccattggatagatcctttctcaggaaagattaagtctcaggaaacattaattttaatgcactctctggaaatgttaagtaaaatataatatatattaataaagtagtaaaagacatacataaataaaatataaactcccttacacatacttacacacaccacatgtttatacatatgaattcaaaccaaacacactgtttacaaatggccatttatttctgggaattagtaagtccaactgtaaacataaagacaatatttatatggtcaagaaaaccaattcactagcttcagttttaactcaatttattaattttattttttaaactctactttctcaaaatgccttttttgttttgttaatgtattttttaaatattatcaaaatggaaaaaataaacttacttttggaaatcatgcattcagcaaatacctactatgtactggaaactgtgctatgcactgagatacaaagatgaataccatgggaccctaagttagccttgacccttgaagagctcatagtccaataaaactgtgttaaaaacaaatttttcaatcaaccaaacattctcttcattgatacaaaggagttctcattagtgagttctcattagtgctctaacacttcctagcccggtggctttgaacaatggatatcttcagaaccctgggatcttcatctgcacaaatgaaaaagctgaactatgcagcctgttgcatcccttctccagtgaaaatatgtgattctaattgccattttaagcccaggttgaactttccctttttttaactaccttccatggctaaaattacaggtattttagacaatgtgcaaatgagtcaatacgtgacattgtgtcaacatgtgcataggtatttattgcatagctatataaatctgggcaccaaaatctccttaagctgataagcaacttcagcaaagtctcagggtacaaaatcaatgtgcaaaatcacaagcattcttatacaccaataacggacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacatttcatgctcatgggtaggaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcattgccaagtcaaccctaagccaaaagaacaaagctggaggcatcacactacctgacttcaaactatactataaggctacagtaaccaaaacagcatggtactggtaccgaaacagagatacagaccaatggaacagaacagagccctcagaaataatgccacatatctatgactatctgatctttgacaaacctgacaaaaacaagaaatggggaaaggattccctatttaataaatggcgctgggaaaactggctaaccatatgtagaaagctgaaactggaccccttccttacaccttatacaaaaattaattcaagatggattaaagacttaaatgttagaccgaaaaccataaaaaccctagaataaaacctaggcaataccattcaggacataggcatggacaaggacttcatgtctaaaacacccaaagcaatggcaacaaaagccaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctataatgaactcaaacaaatttacaagaaaaaacaaacaaccccatcaacaagtgggtgaaggatatgaacagaaacttctcaaaagaagacatttatgcagccaaaagacacatgaaaaaatgctcatcatcacttgccatcagagaaatgcaaatcaaaaccaaaatgagataccatctgacaccagttagaaaggcgatcattaaaaagtcaggaaacaacaggtgctggagaggatgtggagaaataggaacacttttacactgttggtgggactataaactagttcaaccatggtggaagtcggtgtggcaattcctcagggatctagaactagaaataccatttgacccagccatcccattactgggtatatacccaaaggagtataaaacatgctgttataaagacacatgcacacggatgtttattgcggcactattcacaatagcaaaggcttggaatgaacccaaatgtccaacagtgatagactggattgagaaaatgttgcacatatacaccatggaatacaatgcagccataaaaaatgatgagttcatgtcctttgtaggaacatggatgaagctggaaaccatcattctcagcaaactatcgcaaggacaaaaaaccaaacaccgcatgttatcactcataggtgggaattgaacaatgagaacacatggacacaggaaggggaacatcacacactggggactgttgtggggtggggggaggggggagggatagcattaggagatacacctaatgttaaatgacaagttaatgggtgcagcacaccaacatggcacatgtatatatatgtaacaaacctgcacgttgtgcacatgtaccctaaaacttaaagcataataaaaaaaaaaaactgggcacatgttactaaatagagggaatgactacaatcacccaaatcatttaaaaccgaactctttacattaaaattctgagttcgcataaactggtatgttgcatttatatgcactcccattcaatttatgcatgattaatttgcgtgttttggagcaaagaaatgaaattaatacttgtttttaatatacatgtccaaatatcaaaagccacaatttaagccagctgccaaatactgaaagactggtgtacaaactaacaattcttctcagctaaacattagtaatgttataaatagtaacattagttcacagcaacacaaatgccaactttttaacacccctatggctaaatatacagaaaagtatacataattagatagactatctacagatttatttaccatgctatatttattacccattcctgcagagtatttacgtttaactctgtgaagcaaatatccccacaataattttttcctccacattttaaaaatattttactatgaacaatgtggattctatttgtccaaaaaaagggaagagctgggcatggtggctcacgcctgtaatcccagcactttgggaggctgaggagggtggatcacttgaggtcaggggttcaaaaccagcctggccaacatggtgaaaccctgttcctactaaaaatacagaaaagttagccaggcatggtggcagacacctgtaattccagctattcgggagactgaggcaggagaatcccttgaacccgggaagtagaaattgcagtgaggggagatcacgccactgtactacagcctgggtgacagagtgagactctgtcaaaaaaaaaaaaaaaaaggaagaaatgacagcaccatgcatgtaaaaatgcattctttttaaacatcaaaataatcttggacagcgctggagagcatgtggagaaataggaacacttttacactgttggtgggactgtaaactagttcaaccattgtggacgtcagtgtggcgatttctcagggacctagaatgagaaataccgtttgacccagccatcccattactgggtatatacccaaaggaatataaatcatgctgctataaagacacatgcacacatatgtttactgcagcactactcacaatagcaaagacttggaaccaacccaaatgtccaacaatgatagactggattaagaaaatgtggcacatatacaccatggaatacaatgcagccataaaaaatgatgagttcatgtcctttgcagggacatggatgaagctggacaccatcattctcagcaaactatcgcaaggacaaaaaaccaaacaccgcatgttctcactcataggtgggaattgaacaatgagaacactcggacacaggaaggggaacatcacacactggggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtataataaatatatatatataaaatcatcttggaatgtatacaaaattattttaaacaggaatgagttttattcaggtctaccttgcttcaacctccctcctttttgaactggagccccatcctctccagagtctccagggcttctccactcctgggcacctgtcctttagccccttctcaccacactctgccactgtcaacccgtctttactttcccggtaaggccacagtctcctgaagtccagccttaggcaaaggtgacagaggaaaggagaggttaaggtcgctggagttggagaggtcaatgaagagcgagattcaggtgttgaatggctgcctacctggacaaataccactaaaaaatgatcataaacaaaccaatgagcaaatggaaaacagatgtaagatcgtccaagataagtggaagtgcccagggtcttggtagatcacagacgaaagggatacagaatgataaagcataaaatttgggagctggattaattgatcacaaagacaccatctattgctaacatccttttgttagttgatgtattattctagctgggccgtaaacacatctcaggaatcccactgttaatctatatcttcatcagactgcccagataggtctacttcatacctttcctgccctcctgaaatccccagtcagctcctctccatctcagcagaaaagctggcttccttctttactaagaaaaatcaaggtcatcagaaaaaagatttcctcgcacattctcctttccatctcagctcttatgtttcttctcttcctttcttcctatttgagaaaaatccttcctaacttctaagattaaatcctctgcctttgatccccttttcttaggcatattagattgcctctgtaatctactagcttatacgcttattaaccatgtgcccaatgctcagtttcctcagctgtaaaatggagtataatgcccaccgtgcaaggcagttataagatttaaatacaacaacatattaaagcacctgccacagagcagggtgcataacaaaagtgctattattattaccctctaagccttgtctccctcaatggctatgcctgctttctctcgcattagttaaaaattcacttagtgctacctttctaaaaggcgttttagccactggtactataacaacgaacaaaatcaagggaaagatggctcacccttgtgaagtttacagcctagtgggcagggacaggaataaaatacttaagtcaggtgataagcgccatggagttacaacttataaaagagtgtcctgggaggtctcacttaaaagatgacatgtgaacaaagacccaaaagaggagaaagaccaagcaggtatttggagaagagcactcctacgtgagaggacgctgcagtctcctggagggcttgagcttgaggaatgaggagggtgtgtgtttggtgctgggggctgggggagcaggtcaggtttggcagggccttgtaggttactgcaaggaattcaatacttactctagtgaataataaaagagagggggaccctggtggattttgtgcagtggcattatccaacttaagctttattaggatcactttagacactggatgagaacagactcaaggtcaaggaaggagaagggagatgagttcggagactttcaataattcaggagaaagttgatagttgcatagatgtgagaagtagttggattatggctatatttttcaagaagataaaataccaaaaaggttttctgatggatctaatgatcagtgcagagaaagagaggagtcaaagttactcccaaggactaggcccccagaaaccagaaaaatggagcagctctgtattgagataagcaagactgcagggtcatagctttatctctcccccaccactgcttcctgccccctgtggtcaaccgaccaaaggtcttcctcactttaagaaaagaaagcatgttagctttctgctgtcctaatctctcttaatgctcgacactaaatttcttgaacaattgctctgaatccagggtcttcactttctcaagggctccgcccccacccccaccccattccactacagataactctgcttccaaagagcactcccgcagggcaaccagcatactctagtcatccaggccagtagctgcaattctgtgctgcagcatttggcactgcccattattacctccttcctcaaattctctccatggtgggagatctaacatcctgatttacatgtgatggctgtgatcattccttccatagcctcctctttctctttcattgtctcctcctttttcttctcttctctcaaacacagcatcctctgaattctgtcccttgtccccctgaagctacactgccaagaccttacactcatagtctttatgactgtttatagggtctctagcacccagttcagtgactgagacattgttaattgaacaaatgaatgaatttatcattccatcaagtactgtattcctatatttagtttccacctgtctcccaagctccagctttagatccacaaccacgagctacacattccagttagaagtcatcctgccctacgaagttcaccaagccaaaaccaaacactccatcttaaccatccctccacaaagcaagctgcgttattttaactgccctacttattttaagggtatcatgatccccaaataagaactttcacctcttcaagcctaggatatctactagagtctccctctgccctctacaattcattctacaatgccaccagcttaattttctaaaacactattgtgcccatgtcactcatctaataaataatatttattggctccacataaccttcagaagttaagagagaagaagggagagagagcaaaagaatactagctagggcctgattttggctatttctattttccttttaaatatgttttctactaggtacattttcccctttgaaattcttagattaccccacctccagttccttgcctaggcaaagtacagtacaactcttcaaccagatattaaacatcttcaaaaatccagcccctattagcctgttcaatcttattccctaatacagcaagaatcacttcttcctttcagatggtcttgccatccctcaaacaagcattttacattcttacctccatatcactgcttacacaattccctctctggttgttctctcctccatcccctcttctctactctatgttaattgcccatcaaggtcttgctggaatcctacctcgccccagaagcctttcacatacattctaaccaagagtggtttgcagcattcctcccccgaacaccctgcaatttgctgtccttaccactcctgtgtggctcatcacagtgattctaaaaatgtgatcctgaaagcagcagcagcagcagcatcattttgttaaaatgcaaattttggggacccatcccagacctactgattcagaatctctagaggtagatagagcccacctccctgtaatttcacaagctccccaggtaaggctatgcacgctaaagtttaaaaactagtgacatgaaataccgccttacgttgtttgatcttgtcaactaaataatatgcaaaacaccaaatacggtatttagcatatagctatccctcaagaaacttgagttttgcaatactgtttcaagtagtttcatcgcaatatacatcaagtgaattttacctctacacctaattttaaaaaacaaaagtaaaaacaaaatgcctttacgctaaacaatgaaaatactttgttttttaacgtgaaccaagaaaataagccctgtcatagtggctcatccctgtaatcccaacagtttgggaggctgaggtgggaggatcctttgaggccaggagtttgagaccaacctgggcaacatagggagggtctgtctctcaaaaaataaaacaattagcccggagtggtggtgtggacttgcagtcccagctacttagaaggctgaggtgggaggattgcttgatcccaggaatttgaggttgcagtgaactaagattgtgccactgcattcagccctggcccagagtgacaccttgtctcaaaaaacagacaaaaaaaaaaaaaaagaaatgaaattaatattgttttaatcaagagcttgtttaaaatcatttaatttaatattaaatgaataacaaaaataaatgtttttatttagtaataaatcatttaatattaaatagcttaatcttattaattggatgagaatcttcttttacatttcctttacatttcaactttggaaatatagttgagttttcagattacaccttcatggtgaatacaggagaagatagctaaataaaaattcctgccaagagaagagtagaccttaattttaatcaatttgcatgttgcagaagataaaaagtagagccacaccaagctgaaccagatttaacattatgctttgaagaaacccagtaataatgaattacgcacttatttcataggtccgtcctgcttgttttggctctttagaaacctatatttcagaaaggttaaattaattaagcaaagaatcttcttttgtaagaactttcttacaaaagaagagcccaaaatgaaaatgttgtctcctacataaaaaggaaaataatgattaacataaaaaggtcttggaatagtataatatgctccatttatcccccatatcaacaaactttttcttcatgtctattgcaaacagaatacagtggtagctgctatgatagatcttgacgtatttttatatatttagcgtctttagagttttattgccaaaatgtccagggttccatacaagtacattctttttaatataattttctaataaacagaaatactggagagaaatatgccaaaatattatcagggattcctctgataattcctctgagtgaagattttacatgttctttttactctctatttactgttcttgtaatattcaatttttttaatgagcctacattaagttttaaaatctaaaaataattttaggaccatatttttgttttatgcatgcattagtacagtaacttacttctccacttaggaggatactgcttttgcgtcttttttttcatatatcagtttgtttaatccacacaacaaccctatgaaattggtaaaatcattattcccattttacagataggaaaactgagtcacagagaaatttagtacattctacacagaattcaaacacatgaagattaacattagagtttgctcaagtcacccaccaaaaggctgccacccaggctggcaacttacatcctgccttttggcaaatcccaagactagttaattacctctttttgagaatgcatacacagaaacacaacaataagcctgtgtgacactgggaaatgattgattttccttattttgtattgtatcttgacaactcagaagaaaacatgcaaaacgtaatatataaaaattttagtatgcatttttaatagtgtttccaaaccaaaagaactctaagagaagatggcctccttaagacaagaggcaatagccaaaagagaagaaaagattgaaatgaggacacaaatgaaaagaaagaatacaaggaagcctaagatgcaagaggaaagctggaggcaatacagaacacaatcgacttgtggaaaataatacctatgctgtgaaagacaaacatgatcacaaccagatgcaatttcaaaagacggatacaaaaataaataaggaaaaggtgatagagagggaacatacagcacagagatccaaactaagtaggaagaaattcaatagtaaggaacagaaccaaaaataaaaatagtaaagataaatattcacatgtggacaaaaacctgctcccaggagcaaaactacagtgagtactaagcaaaataactgaaaacaaaccctatatctatgcctaaaaaagtaatttccattattttcccaaactcatagcactaaccagacggaaaatcaggttaactacaaagtaatagatatcaaattagccctaagcctctctttcacaatattaaacaccattagcctatgaaccatctaagtttggtagcaaaagtttatgataaaatccttgtattccctgacaaattattgttcatttaaaaaaggcaaaagaaacattttaagcaatgtgaagcctcataaaacactgcacgtgtataacattctcataaaaatctattccaagtatacattccagctaagtgaataaaaactcaaaataaagaactcaatataatagagcaggaaatgcctaatttcatgtaatgaccaatttaatgcaaaaggctaaaagcatccttgaaaaacaatgagttgtacttaatatcttcacattttaatttaaaacaaaaaataagaagcatataatattaaattgatatcagataatataatgtatttttaatctatagcatcaaattgaattaacaaacactggaaggatgaggtcagtgtaggagaaataaaatttaacttgactcttttttatgtaatggggacattaaaggattccttttttaattaatttgcataattagagaactacaggtttaagtatatattcaaattggatttttgaaaacagtctatatagaaaaacaaagaaaacactaaagaaagtagaataaataaaatgagaagagatcaaacacatcatttatggctgtaaaaccaaatggtttaaattcctcctttaaaagaaacctcttacattgggttcaaaaagtaaatcttactatatatgctgctttcaagtgatacagcaaaaacaaatcaagacaaattatagaaagaaaaggaaaatcatacataattgagcaaacacaaagtaaaacaaacaaaacaccttatgaaaccagatgtaattcttaggaaaagtcattacctgaaacagagtgcttatattaataaaaatcaaaatctactgtgtataactgttaaaacttttatgcggcaaatattgcatcacagacacagaacacacacacagacatacacacacatgcacatacacgtgtgcaacaaaaacacaaattataacagcagattaaaaagctattcttatctgatatttccaaataaaatttaaaataattttttcagatcctaaaacaaattcctgcttgatatttttattgaaattccatattaatatgggaataatattactaaattttcctattcagaaacatgagatatttttgcattaattcaggcctttagtatgtcccttgttaggttttaattttttcttcatataagtcctgcagatttcttattacattaatttctagatattttacacttattattattaagaatatctgttttcttttctttttccttttttttttttttttttttttttttgagacagagtctcactctgacacccaggctggagtgcagaagcatgagctcagctcgctacaaccaccacctcctgggttcaagtgattcttgtacctcagcctccctagtagctgggattataggtgcccagctaattattttgtatttttagtagaggcagggttttgccatattggccagactggtctcgaactcctgacctcaggcgatctgcctgccttggcctcccaaagtgctgggattacaggtgtgagccaccatgcctggccaagggtatcttttttcaaatatattttgtaattgattgtttttcttggctcacaaaaatactattgatttgggtatatttattttgtatccagccacattgctgaattgttattgttctaatatatctttagttgattctctaagtttttgaggtatcatctgtaaatgatgacaaggttgtccctgtcatcttgtaactcttttttacttatttatttatttatttatttattttttttgagacaaagtcttgctctgttgcccaggctggaatacagtggtaccagcatagctcactgcagcctcaaactcctgggctcaagcaatcttcctacctcagcctcctgagaagctaagactacaggtgcataccactatatctggttaattttttaaaattgtttttagagacagggtctttctatgttgcccaggctggtcttgaactcctggcctcaagccatcctcccaccttggcctcccaaaacactggaattacagacatgagccactgtgcctggccctcatcctcttataattcttgtttcttttatgtcttgcctttattcaatggctaacatttccattacattatatattattattggttattatctgattcctgacaccttgatatcatccctcactttaaaaagaacatgcattaattaggatgtttgcaactgcaagtaaaaaaaaacacacaactgagagtggcttaaacaatgtggaaattgtattatctatataatatgaagactggagtcaggccagttccagggttgattaattcagatgctcaataatgtagggacctgatacgtttattctgtgattctcctggctttcccctcatggttgtcagatggctggagcaaacctaagtatcacagtctttagataatatccaagtccaggatagggaagatatctttttacatatttacttgtaaaagaaaggaaagccttcccaggaacccccagtgaggcttcctctggccttcttattggacaggttgtgttgcatgacttgcttaagccaatcatcaacaaaaagaatggaatcccaatgactggcttaatctattctacctcccccatgctggggaagtggaggtcaacttcctctgagaatgtggaaaggtaaacaccaaaacacatccagagctctgtgagaaagaaaaaggatggggatgactgccgggtagggaaccaacagtgtgcaccacagagagtctctggtgtttaaaggataggtacagggatgactattggttttagacatattatcaagttaagaaagaatgtccttaatcctagtctattaaaaatagtttttgctttgttttttaatcaaaaataactgctaagttgtaccccatacctttttgacatccattgaaatgatcccataattaatgtcctttggtctactaatatgttgtattaatagacttcctaagacagaaataagggggcttacatagcattttctgtgttttcagttccatactgttaattagcaatttttagggtttttcatacaaagcaagaaacacacattattgcttattaataaataatacttcacatataaaaagtttccagatcctaagccagaaaaattgaagagggagaaatgaatcagagggtgacaggcaagaaagacagacagaacaactcagacatgaagtgatatggcttgttctggagtgggggcagtagggcaggaaagcatggaaggaacacaaagcttacttctaagacacaacacatgcagacttaatctatatcaatattttacatcaatggcattctcatcatagcattgggaatcactgagaattgctttaagttatttcagctccatgaaactcccactcctgaccttccctccatctggtccacttccctccatcttccccactcctatacagctagccatctaccctggtgctctgacaatactctttatctatttttacatctgtttttaccactacactttgaacttcttggaggcagaacctaataccttgtaaacctacatatacccagttgcttgcactgcaccagattcagagtaggctctcaaattgtttgcaagagtgatgctgatgttgaatgtattgaacatttattgtgtatttgcaacatggcaggcactgtcataaatacttaacataaaatatgtctttttaattccagcaatagtcctatgtgtactgttattgttacctccatttcataggtgtagaaaagtgtagggattttacataacttgtcacaagctgcaaagctagtaagctatagcaccaagattcaaatccagagagtccaacccctgatgtaatcgtaagtcattttccttcctgtgactttgaaaacaaatgagataagccagaagctcacaaatgagcccaaattatttcatggtcaccttttatacacgttactctctgaggtgccaaaaacgttctggctaaatgctctgccaaggtgtcatctggggaatcctaaccagacactagaggctatcatcattcatttacatgccttgattttcaaaagactgagaacaggttgaagatttgaacattgcagcacaaatctgcatcaaacagacagtgtatctacctttcatccccatccccagcctcacacagagccagtgcatttgcccccttggatcatttggcgaggctgtcaagaaccttaacacccctcaaaaagaatgaaatcaagcacagcggcatctgtgccagttcctctctttttttattactgcccccaaagcctataaaagcttggaatctattaattctttctttatagctggaatgtctactcattattatctgagaaaggaagagtcaatttaatacatttgatttcaaagattctatccagtgaagtcatagttcattgcagtcatatcagctgattactgtaaagtgcaacagtctgcatttgtaaaggaaaaaagcacccaagcttagtaggaggtacacagtagagaacgtgggagacatcgggatagcatttgctgctgaactgcattttgcagacctgaccaccccttccactttgctctgttccaggaatgccatttaactgtcatgggccttatccccctatagctgtaggataaccacaagagccagtgagcactcactaaagctaatcaatatttagaagctaaaaatgaaacgaagaaacacacaaatgcaagcataggcaggggaggcttttaccctgtgcctccaagacctatgtctaagctaatacatgcaactgcttctgggatttatggctgcatttattcaaaccctgtagcctctgaagaacagctcatcctctccttccatattagattggaccagccagaggcaggcccttctctgccaacagtcagggaggtgagagtaaatctgccaccatgtagattccatcattctcaactcctatcaggtaactgaaatccacctataatctgtcacccatgccaaggccatgtttgaacttcatttgatgccctgtgttagaaagaatctttcttgctcacatgcttcttaaaagcagaattagatggctccagatgacttaaacaaaaatctgagggcctacaatgtgccactaatgacaggtgctgaggaaatccggggagttgataaccagctaatcagctagctagctatccacgccatgaggcggcaaaatgtcttttcccatactttcctgttagccactggggaagctgccccacagacagtgctttttagagtgcatagagcagacatgggaatataactgctgcacctgcacagtgacttgtcgccaataaaaattcacctgtgtctcatttattgagcctgtacttataaagaggtttatagtctgttgtcttaatgaaccactttaaagtctaaaggggagatagaagagcaatgagtagaggccatttcaccatctcagggccctctcagtttcttccccttgcatagcacctaggaggtttctaacaatgcaagcattaagacccacagctgcctaggacacaggtctttccatttcccaggggtcctgcactttgttaaggtttggtttcccagaatcacaatccctcctcttaaaggctaaaaacacatgaaattgtattttcacaactgcatagcaagtcgcctgtccactcagttatagtggggatgcaggatccaaacacgatgactcccagaagacacgtcctggtgaattacgtgttaggcacactgcagaatgcaaatgtaaacaagtcacttgagaaagtgtcttaagttcctgcccttaagaagcttataatttaaatacaccaatggcttgtggacaaatcattctgaagcaaaacagagatgcaggtgataaaaagtgtgaacagagcaaggcagaaaaacaaaagtaaggattaacattaaccaggggacctagatgatgaaccaaacctccctgatatgtttttcataagaaagtgtcttagtaacaggggttttgtggctcgatcaggttaacaaaaggaagagtgtgtgggtttccagccctgtccaaccaccacttgtggtgggatcagaatttggactccacgctccaggttcaaccccagcctcattccaaccctgtcaagcacatttctaatcaaagtttcagagtcctatgtccctccaaaatcagaagtacagttccccagagagcagacagtagttctaccattagaaaagcattcccactatttatttagaaaatgggaagcagcaatagcacaatgcttacatttcatgttttaaaatcggactagccaggcacagtggctcacgcctgtaatcccagcactttgggaggccgaggcaggcggatcacaaggtcaggagatcgaaaccatcctggctaacatggtgaaaccctgtctctactaaaaattcaaaaaattagctgggcatggtggtggatgcctatagtcccagctacttgggaggctgaggcaggagaatggcatgaacccgggaggcggagcttgcagtgagctgagatggtgccactgcactccagcctgggtgacagagcaagactctgtctcaaaaaaaaaaaaagaaaaagaaaaaaaattggaccaaactaggttcaaaaactggctccatcattttcaataaatcacttaacctaagcctcactttccacatctataaaattagaatagtatatatcacaagatgtggctgcattaataagactagacttttattaaaataattaacccagtgcttgacacgtggccagtggtcacaaagtatattagctataaatattggtattaaattttgttctttctcatctcccactgcttcaatcgactagcctaaatgcatgtgtattactattattattatataaattacactccagatcagtgtcaggtacatccacatgttggtgtgacctgagactctatcctagccacatttcagtatagttcttggaactgcaaagcttaggaccaaatcctggaccacaaattcctcgctgaaagtcttgccctaaccaaggccagcatgtgccactggcctgtgccacccacccacctggccctcactcaacacctagcacacacagccctcagaagctcagcatgtgctcagtttccactggtttcatgaacattctactcttgtctcccagctgctccgagggaagggccatactctccccattactcaacctcactgtggcacatggtagaagcctgcacagttttcctgtacataatatgacagtgtccatgatttttctctccctctgtttttatgatagccaagaccatgctaggctgggcgaatgaccacaatgattactggagctgagcctccacccagttctgcagactcttaagccctcttcctttctccacatttcctagagggtattctcaaggccatggtggctactgcagtttccagcaactcattcctccttgattactgcccctttccttccctcgccatcatagtaatggtgagtaacagtaacagtaaacataggaacatttttctactctattctaattttttttcaaaatctgattgcaacccattaaactcactccacaacccattacaatttgaaaaacacctggtatctgtgattccaggaagatgacatgctaaaaggagctctgatcatttgagaaaaggaattccccaactttgtgggaacaaaagagctgagctctaggggtaacagtggaggaaataaagtgtatggaggtggaatggggtggtagttactgatactgtagaaaaatagggaatggttagatcatagaaggtcttgctaagttaaggagtttagcctatgctgtaagtcacgagcaggcattcatttcattaataaatggatacaaggatacacaaaacatagcttgcctttgtggagcttatagtctcttctgcaggaagagggtgtggagggagacaaccaaataatttgttaacaaatgaacaaatggcacattatgataggggcttgggaagagtttcaggcagcaggaacagtgtgcataacagcatagaggtgagaaaagcatggaacattaagaaaacagaaagagttagtaaggaatggttttagacaggaatagctctcccagtcctggccccaaagtcctttctctacaggaggaataagttatttgagctaccttatcttgaaggaaatgattatcgttatgtttgtaaaatatgacaagcgcttcagaataaagaatgacacgaaaatacgtagaaagcagaagataggatcagagaacccatctatctctccaggtgttgaagagatggccttcctagaaatatcacagagacctgactaggaaatttgccttcacggtgtgtggagctggtcaactatgaagcagtgtctcaggcatattatactttaacacctttattgaggtacttacataccataaaattcactcaggttaccaccatccaatattgaagcattttcatcacccaaaaagatccctccggcccatttacaggcactccctgttttcctctccaccctagccaaccagtaatctactttctacctccgtagatttgcattttctagacatttcatatatacagaatcatacaatatgcaatcattgtgtctggcttctttcacttagcataacattttgaggttcatgcatgctgcagcctgattcagtacttccttcatttttattgcctaatagtattctattgtatgaaaacactacactttgtttacctatccatcagttgatagacatttgggtggtttccatttttgggccactgtgaatgatgctcctcatgaacactcctgtacaagtttctgtgtggacctatgttttcatttctcttgggtacatacgcagaagtggacttgctaggtcgtgtagtaagtttaactttttcagaaatagccaaactgtttttcaaagtggctgagttatttcatagacccaccggcaatgtatgagagttccagtttctgcatattcttaggtatatttttaaattcagatttacatgtattgtggaggaagcatcccctggataaaggtttgactttatcaagtctgtgaagtgcagagttcacatgatctcacaacttatgcacattccaagtttcacttaaatgtacttaaaaaattttgagagctgtccatttgaaaacatggttgaaataattcagtataaaaatgcgatactaaacaaccaagtaaatataatgatcatagaaattttaaccagaatatttgtcaaaggggagttattaaggaaccatgcaactcaaataaaaatgttccttgcaaactaaacaaaatctccacagggacaaaatcctgattgtgaatcctgcaaaccagcagcaacttatagaaggcagcagccacacggaggaaacaggaaagaaggacaggggattatttttttaaatctgatgcaacttgcattgtatcaagtgatgagatacaagagaccttgcttccagaaaagaaaagaaacagacctggcctcaaagggacagagaacttaatagtcacaggaatgtccctgctgctttgaatacccccaggtactctttgcaaacatacacactaattaaagggggttgggggactgaactggcaagagctttggttcagagatcacagagggacacccagccttcaaaccccttcaacagactctttcaatctagaaagcaaaccctgtatctggggctcggatctctgtatctctctaagatttattttaagtatcatacatatttcactgaatgtctacgatttcctctcttcatagagaggcttcctcctgaagaaggaccctttttgtttccagtgatgaggacctataataattatccactggcactttttctggtgcaatcagtgaaatggaggtttaggtacccagctggtcaggttccagcagatttcccatgctaattttcagtcactcaaagaaaacaaaggaaaaactaagattggtttaccatgattttaaagaaatactgttcctcttccctttccccctcccccaaaatgtgtaaacttctatatttcacacttttacatctgttcttctcccaaaataaaagctgtttatattcaagaaatgatggctacaataccagcacaagttacatctttaaaatactcccagagagaatatacatattgttcagacaacagagtgtctgtgcaatgttctttccctgaatagcatctgggtattggctctagaaagcactacagcgctttatttgtttatttgtttgcatggaaagaaaactgagtactctctaactggtgctggagctaccaatttaaagaagacagaagaagcagaggccttttaggaagagcaaatgcttagttttgactctgtcaaccattccagagtaagacaccagcaacagaaccacctggttccactgctacccagagtatccatgctctgaaagtcttggagctcaattgaaaaatcgcagcactcccaaactcaaagggccctttcaaccacgccaattgcaacatatattatctcaagcgttggaggaatcagataaacaggctgtgaaaaagccatttcaaatttgtagctttcttagacagagtctatgatttcaccaccactagaaaggaaactgctccaaacttagttccagacggaagttttcaaatgatgtcattcattgtcccatctagagcagttagtattcccgatttaaaggcttgaacagggcccagcacactggctcctacctgtaatcccagcacttttgggaggctgagcccaagagtttgagaccacgctgggcaacatagggagaccccccatctctacaaaaaaaaaaaatttcaaaaaattagctgggtgtggtagcacacacctgtagtcccagctcaagaggctgaagtgggaggatcacttgtacccagaagtttgaggctacagtgagccatgattgagccactgcactccagcctgggcaacagagcaagaccctgcctcaaaaaataaaataaaaataaaatgcttgaacaattccctgatactttaatgatattaacacctcttctgagaaaactggagctatccctctaagtgtcaatactgggaaaaacctaataatctttaaccaggtattttttatatctagtctgatgatgattgtctaaccatcggtttttccttcaaaatagttcttctatgaggggaggtcttcaaatttacatttttaaaagcattttccccagcaatgagtataaaattttcatgcacgctcactatcagttgtatataaagttgctttaacaaccatacttgccatcaacttttcctccatataaacagacatgcaatataagcaatgtgcttatctaagaactgtggattaaatagcaacatgggacacttttgtggctaggtaagagatgcttacaagttgttgttacaaagaaagtctgtgggatttcccagtaaggaaatcttcaacctgctgtctagattccaaatatacattccatttcccaggtctcaaaaaataaataactcgaagattttaggcttctaacagaagtagggctgaaagaatttgtgaatatggattctttctttcagtttccaagcaaatgtcagcacctcctggggcttcaaactcaatccctacaggcctatagggaaaaacaggaaatcgacatcagaaggatgcatcttgttgatcaagggagtggggcttttctgcaccttgaataaacttgctaaaaaaaaaaaaaaaaagaaaaagacatgtcaatgcaaagaacaatgcaaagtacagaattatcaattgaaagttgtagacttttcaatttcaagtatctttgagtcttacaaacaattcaaatgcaaatattagtaaaaaaattttaacttccatactcctaagaatgtgtactgtccacaatttctctgaggtcatatgccttatgaaaaagttgcacttaccataaataatttactatttcctattctgcaacattttcaggcatacccaaatttccatgaatatattttgcttttcttttttattttattttattttattgagatatggtctcgccatgttgcccaggctgatttcacactcctgggctcaagtgaagcttccaccttggcctcccaaagtgctgggattacaggcatgagccaccatgcccagccaaggaaactatcttttaaacatttaggccagtggttctcagactcccacatgcttctgaattactaggagggcttcttaacgcaaaagttgctggtccccatcctaagagtttctgattcaatagttgagcgagcccaggcatggtggctcacgcctgtaatcctagcactttgagaggctgaggcaggcagatcccttgagcttaggaatccgagatcacgtaggaaagcccttctctataaaaaatacaaaaatcagtcaggtatggtggcacatgcctgtagtacttgctaccccaggagctgagatgagagaatcacctgagaaccggaggtcgaagctgcagtgagctgagatcgcaccactggactccagcctgggtgacagagtgagaccctgtctccaaaaaaaaaaaaaaaaagttgagagaggcagggcctaacagaggatcctgaagctgctggtccaaggatcccactttgagaactgctgacttagggagttaaactgtcaactagcttttagaaaatcacaacatgcaggataacatttactgagaatctaccaactgcagaactctctactacctactgagtaagccgcacaggtccttgctccaaacaccatctaaattggcaacacagggtatacgtgcgaggggacaatacacagacacatatccaaaacagcaagaagtagttaatacagtcaaactaaagatgtttcatttctccagtgcatttctttatgatgtatcctacggtgcagttaaatctattactctcagatggacattactaaaccacaatgcgtagccattcttccttgcactatgccacttcatttcacttactaatggcagtttcatctgaagccagggcatgaaatgtagagagggacctcattttaaagcttatttatgttattcgtgttgtagcaactgtaaggatcagtgtgatgatcaacactcagatttcagtgataagttatcaagcagagtcatcgagtgcagatatgatctaattctgccatcaggctgaactgaaatgcacaaaaacagtccaacagaatctgaactctaactttcccatcattgtataggtttttaaagcatagctagcaccaactttcaaatgcatacttttctcatgaccctgtcctgagtttaagtgcatttgtatccagattataatcagagagggtatttaattagataatgtttgcaagtactttgaagatataaagtgctctataaatgctaaatattattattattgtttaaatacagtttgcaattactgcttacaacctgttccacccaccacactgctatcatttgattacaggcagctttaaaaaaaatacctagaggtagaaatgatgaaaccatattcatgtgaagccctggatttttaccctagacataaataatttataggcattttaaatggaggattaggttataaactgtagtaaatcaagaaaattgccctctgcaagaccaactaccataaagttgtgtcaattttaatagtttcttacttataaaccaggttgaaagtagattatagtccagaatacggagctttttactctggtggtttcctgttctatcttctattttctccattagaatcttaaaatatctacctatgtgaaaaactgaaagcacaacttaagattttgattttagcaattgtctggcagattaaggcttgagaatagtctctattctatcatggccgtagctcaccttgctatcttctatgatcatcacagagtcagctgtctccaattcttaaaaaactgaaacctttgagcctgattccacacatcctccaaacacacttgctggataattttccagaaagaatgacagtttaaatgtaaacaagccaagctcagtggctcacgccggtaatcccagcactttgggaagctgaggcgggcggatcacctgaggtcaggggtttgagaccagcctggccaacacagttaaaccttatctctactaaaaatacaaaaattagttgggcgtggtggcgagcgcctgtaatcccagctactcaggaggctgaggcgggagaatcgcctgaacccaggaggcagaggttgcagtgagcagagatcgccccactgcactccagcctgggtaacagagctagactccatctcaaacaaacaaataaataaataaataaacaaacaaacatcccctagatacactccacaagaatgtcactgttaatccccaaatagctaccatattaggtttttaaggttttaggcaagaaaaaaaaaaaaacacgttataatctgacattggtcatcttacaaaacaaagttacaaggaagaaataccttggaaatagctcttaaaacaccactatgctcatgaaagacaacttgtgccctaaaccaaaggcttctgggaagtctgtgagcctcagggtgataatacaacagataattctgatgtcatgacaaggtccataaatcaaatgatggctatgtgagtcactattggcagtggctttgggccagtcagtcgtaagctcagccacttagtagctctacgatctttggtaaactaattgatttttcagagtcttatgtgttcatttataaatgctacacacctacagcacaagaaattggaagccaatctggcaatatctagagccttagagatcattcatacactttcattctaaattcaatttctaaggagttatcctaaggaaacagagatgcacacaaagacttatatataaggatgtttattgaagcactatttatcagttggaaagttagaaataacctcaagcttcatcaacaggaactggttaaatatattatgatccatctccacaacaaaatgctaagcagtctaaaaacatgattagaaagttgagcactgactgaatattttattacacgttaaattttttaggcatgataatactattatggttatgtattttttaagtacacaaactactgaaatatttataaatgaaataatatgctactttaaaataatatgggggagaaggtgggtaggagtacagatgaaacaggattcattatgggggataattgttcagtagagagattattaacccttttatctactttttaataagagttttattgagctttaattcacattccataagacttactcttttgaagtgtacaagtgacttttagtatgtttcacagagttgtacaaacatctgcactatctaatttgggacgttagcagtcactccctgccagcaagcattagtctaccttctatctctatggatttgcttattccagacattttatataaatggaatcatacaaccatgtgtcttctcgtgtttggcttttttcacatagcataatgttcatccatgttgcagtgtgtatcagcacttccttttattgtagaataaatattccattgtaaggatatactatgctacattttgtttattcattcattggttgatggacacttgggttgtctcctatttgaggttactataaatattcatgtacacttttttttttttttttttgcatgaatacgtccttagttctcttgggcatatacttaggagtgaaattcctgggtcacatggtaactctgtatttagcattttgagaaactgtcaaactgttttccaaaatggctgtaccattttacattcctatcagtaatataggagcattccaatattctgtctacttattattattatactttgagttccgggatacatgtacagaacgtgcaggtttgttacataggtatacatgtgccatggtggtttgctgcacccatcaacccatcatatacattaggtatttctcctaatgctatccctcccctagccccccatttactgacaagccccggtgtgtgttattcccctccctgtgtacatatgttctcattgttcaactcccacttatgagtaagaacatacagtgtttggttttctgttcttgtgttagtttgctgagaatgatggtttccagcttcacccatgtccctgcaaaggacatgaactcatccttttttatggctgtgtagcattccatggtgtatatgtgccacattttctttatccagtctatcattgatgggcatttgggttggttccaagtctttgctattgtgaacagtgccataataaacatacatgtgcatgtgcctttacagtagaatgaattataatcctttgggtatatacccagtaatgggattgttgggtcaaatggtatttctggttctagatctttgaggaatcgccacaccgtcttccacaatggttgaactaatttacactcccaacagtgtaaaagcgttcctatttctccatgtcctccccagcatctgttgtttcctgtaatctgtctaccttttaagtttaaattccccatgaaaaagagttttaaaagttatgccatagaaaaagattaatagcatgagaaaaggctaattattaggtttaaaaaataggttacatataatatgtacaatattatctccactttaaaaaaaatctatttatccatgcataggaaaaaactactaagccatacaccaaagtgcatatgtggttatcattaggaatcataagtttaaataatttgagaattctttttattttttctccattttccaaattttctgcactgaccatgcagaaaccattgcaatgaccattgcttttacaatgagaaccagaaaagccttttaaaaattaaacaaaatttttgggaggccaaggagggtggatcacctgaggtcacaagttcgagaccagcctggccaacatggtgaaaccccgtctctactataagtataaaaattagccaggtgtagtggtgggcacctgtaatcccagctacttgggaggctgaggcaagagaattgcttgaacccaggagacggaggttgcagtcagccaacacggtgccactgcactccagcctgggtgatgaagtgagactccgtctcaaacataaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtaacctttattttcaacatctgaagcattgctacttatctatattgattaacttagctgagttctcctctaccatctaattagatttggtttcttcacagtggagcacaggctatcttcagtgtgttccgtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaagtaacttctctgaccccaaatttctacctacaaaagaggtaaattggatcaccaatcaccaagccctaggcagacagatagataagtagatatatagacaaagatatgcaaacacaatccccctttacttttcattttagccttaacatggttttatggctttatcctatttatgccttttatcagaaggtgccacaacttactttttggaggtatgaggtgtaataaataaataagatcccttttaaatgaatgaattaattgcattcacacaattgatatttattcaatcaacatttatcatgtgccagacacagttcaaagcaccaggaatgtggtgctgaacatgcaggcaagatccctattctcacaaaacttattaggctccagttgggacagccagatttttaaaaaattcagatagtcacgactgccttaaagataataaagcactgaattggacagtttcagggtggaagggagtgttactttacagatatattgcaaagaaagcctctctgtttagtagggagcctctaagagggccctcagtgacttctgccttctggtgttagttaatattcttgtgtagtccccttcgaaatgaatagggctgacttgggtagccaacagggtattgcagaaatgatggtgtgtgatttccaaggctaggtcataaaagacatagtggcttctgctctgctttcttgattcctctatctggtaaaagtgggcacgatgttatgaggatgctcaagcaaccaatggagccacctacgtggggaggaactgaggcctcctgccaacatccagcaccacataagtaaatcatcttggaaagagatcctccagctccagtcaagccttcagaagatagctcaccttgccaaaatcttcctgcaacctcaggagatacctcatgctaaaaccacccaggtaagccacttctgaattcctggcccacagaaactgtgagatataataaatggttattgttgtttaggccactaagcttgagggtagtctgctatgcagatacataagtaataatacaggcagcatctcaccttagacctaaataataagatggagccctccatgtgaaatttctgacacggagaactacaagaatgagcttggcatattcacaaaacagaaaaaaatcagtgtggctagagtgtagtaaaagacaagtgcaggctctcttctccatccaaccatgggtgtagaaaccatgccaatgttgtcttcagctcagccccagcaactagtagcacccaataatcaggtactgaatgaatatatacacaaacaaataaatgaatgaatgctggataccatgtgcatttcttcccctacagttaatcacatttcacagaatcacagaatactgggcctgaatttaccctgcacccaaacttgcaccttctaatacactaatcaaacaaatgtttgtaacatatgcaatgtattgttaaagtctacaaatttcctacttgatgcatactgccaaggttctaatttcactaactagagagacagcactttaaaatctagggttacttcagagtctaaatccgggtatccagcagcaacactgtaagggagtacccagcggaagtcacagtcagcccttcgtcctatcactcggtcttcaaaaactagaacaacactttaaattataaatcagaatctgacagctggaaaaaaatagctcatttaaaaattagaaagggatgttacgttcagtggcaattcccagctcattgaggtgcacagtttgcaatctcttggtatctccaacagatagaataagaatccatggctatttaaatgccctcagtcctgcctctagttcccttacatattccaggaatatgcatcccagcaatacaaattgctggaagtcacctccagcaatttctagtccaaaccactcatcttacatgtgacaaaactgaagcttagagggcaaggtgtcagagccagctttatgacgctgggctctaactcccagctgtgtgcctcattaaacctcaccatctcccaaactctctctacccgctcactgccagctctgtcaagataaaaactcaacgttgtcttccagtgggccaccccagaagcacaccctttcccgcccatctattactgtttaatcaaaacagcagtcataagtattatccgattgttgaaataattgaaacacactccaaacacacacacacacacacacacacacacacacacacacacacatacgccttgcaattctaacccatggtattttaaatctctcaaaacttagaataagacaatggagagaacactttccttggcagaaaaattctagaaataggaatacctacccaggaccaggcatagtatttctcgtaattggtgcccccggaattgtactctatgtaattagcatccactggaattgtactctacataaaaagtgtccccaggagtcatgcaacctagactataatgtaattcatgatccctgaaattgtgccatggtcagcaacaggccccacctttctgaggtttctatactctctctacatagcaccacctccagcccttctaaaagggttgcacagtatatattttgttaattcaaaatttatttgttgaacgaacgcctgctgtgtaaagaaaactggtgaggatccctaagaaaatcaaacgttgcctctaaaaaggaattgtctagtagtgaatataatccaagacagaaagttctgagtgttatgaaagaggtgtgaggtcagttctgagacagtctatgagtgggagggacaacttgagagaaatcagagacttctgtggaaaaggtggtctgcgaatgttcagcgttggggcagtaggtacagaaaggagactaagacagagcgccccctacagagcatccatgggggaatgaaattgttccctgccgcaatgggggagtggtcgtcaaaactgcagagctcggtgggaggcccctctgaattgccgctggtcttaacatgctaaagagtttagttttcagtctgtagactaaggagacagagaaggccttgaataaaaacaaccagattgaaactgtgcgtttggaagactcacgtggctacagtgtacgagaaaccagtcagaagaaggctggtggtagagacacaggaggaggggaggtcctgttgcgggtgttgcccaggggacagtaactacagcacttgcagggaacagtggagacaaggggacccatatgataaacattaagggaagaattttaagttggggtgatataaaatgtgttttgagaaactgagggcacccccatgagacaaccaggacatgtaaaaaagagtggatagaatcatgtttctctaaagggaaataagcttccaaccagactggaaggaatcacaagcggaattcatccaacattttctacttaagtcctccctctctctccactagagaccttatatttatatgtgcagaataacatttcattcaaaaaatatcattaagattttcttagaattctcagcacactgctaacaaaccagtttaggccctgttctcagagagctacttcccccacagaaatgtaagaatcaatttgacattaaagcatctttcagactcaagttactccagattctatcaggaagggaatcagagactggttgtgctcagctgggcatggcggccatgattcaatcacaggagcgcctggctgggtggactttagaaccactatcactgagagaaggaatggcgtcgaaacaagaagggcacggaagattaattccagggcagagacacagaaagaagaaaggccgaacgggcaagactcgaaattataagatatcaaagagttttacagataagggggaaaaaaggaatatttcctgaaagaaatgtactgggtactctctcatcaacaaaatattacatgacctcctaagtagataattatgcaaacagcaaaccatgacttacactggcttttgtactaaagattactccagttaataatgaataatgaaaatgattatgcatatttctctgatgttctgataaataccagcacaccctactttttatgaggcaatgccattgtaaagaaaacacctgtttagtatctctgaaaaataaaaagaatatctaatgaaaaaattgccatgctgttatcattttgagatactgttatcaactcatgcaactttactaaaatctcattttagaccaaatttaattaagtgctctggagtaatgaactaataatgtttcgagatttctttgagccccatgagacctctcaccagaaagttttaaatactgggccattagtgtatcattttatgtgtccactctatctcccaagggaaaagataaaactttaggaaggcacagtcatgatcaatgtgtttgtatttgaataatcggtaatacataaagagagaaaactttttttaaaaaagaaggttttaatgaacaatgctgatagttgatactagtttagaaatatgttaatctccaaaaaacttcagggctgcacttacctcatatgtaatgaatgcttaatactgggggcgcaaagctcaattcaggccatcaaagaaacatacaaggtcacattggtacacaaaaggaaaaaggcagctaaggtctgtggaggtactgttaaaaagagtcggaaccttctgatatctttttctgaagattattttccttcttttcttagtcttcttttttttttcttaaacaagatgtcactctgtcactgaggctggagtgccgtgacacaatcacagcctcgacttctcaggctcaaactatcttcccacctcagtctcccaattagctgggaccacaggcacacaccaccacactgactttttttttttttttttagagatggagtctccctacattgcccatgatgatctgaaactcctggtttcaagcagtcctcccacttcggcctcccgaagtgctgggattacaggtgtgagccactgtgcccaggaaagataattttctattagataaaatcattgcaatcaaatgttgatggtatcaattttcccactaaattctacttaaccatgggatagcatatttgtacagtgctgtatggtttttaaagcattgccttaaatactttattgattttgaaaccagtatgtgagaaaggcaaacagttgtgatgattcttattaactatggttaaatgtcctacccaaagtcacagagtgaataagaggtggacatagaactggggagacagggttcattccactccattcattcaagcattcattcacgtactcattcatccaactaatggagactatggctccaaagatgaacaagatctagcctctgccctcaagaagtccacggtttagtaaagaagcagaaaggaaatcacacaccaagtaaaacatgagcatgaaaagtgtagcaaagggatgtatgcaaggctttcagatgaggtcaattcttaaatctgggtttcaatggagaaaggaatggctagggaatgagggctaaggggaaagacaagtgtagatcatctaattttgttcaaatacaaaagtgtatgtgagtcctggcagaagctgagagtatgaggtcagcagcagccaactcctggccttgaatgccttaccctgtgggccaagttaaggacagccaaggtgcttaggtccagaaatatgctaatctccaaaaagctttctgggctgagctcgcctcatatgtaataaagcacactggtggcaactttcatctcttttaatactgagatgtcttgaagcaagaatgactcaagccccaggtttgaatgagtaaattgtttgctgtagcctatgtatgtatacacacattttcatacacccacgtggatacggtttatatccataatactacacataatatatgtatccacatagataatacaaaacatacacacaactctataaacctcacatgcagagccatctgaataacatgtatgtttatactgaccccttgagacatgctctgatggacacaggttactcagagaggttacctgtgcaggacaaccatgtgtcctaggtgatttcagacagtcgtttgcctgcagagtaggcattgaaccagggctggacaagatgaattccaaaggtggcctagagctccatggtttcatgtatcacaagcttacttgcatgaagtagtttcgccattctcaataaataaaattccctgaccctggtgaaattattcctttctgctattcttttgtactcaggcagaaaatgtattattgatttctgattccaccacagaaagtgtgacttagagaaaagagcactgaatgaggagtcaggaaatctagattatttcctcaaaccacgctcctcgctgtcccctccccttgttactgtgtgaccttgaacaacttacttcacgcctctgggcttcagtttcccaagtgttcaatgaaaggagtggctgagtgttctacaattctctttccagctctgaatctataaaacaattccagcccatccctcaagatttagtttatctctgagctctaaaaatcagggctaaaactggattcaaagtacctattttctaaccaaagaagatcctgcttcactcacttttaaaccatgcaaatcttgcataatttaaatgatcagtgctgtcattggttgctctggtttaaattatgcattgttgctatttggggaaaatttagactgggtccggtctggaatcactggctgagaacaataagcccccaaagtgagaaggataaaggcctctctagacaggatctgcttttaatgctttgagcccagggtttacaaaaagagcattgactgtgtacattaaagagccaccgaaacagcgagggactggtaagtctgcagcaaattctcccagaagccactgaccttggctgcatttcaggggtcaggcattccccaggaggggctcagcaggcagactttaccaagggcttaggaacaaatgagacatctcatctagatgaggccacctctccaaatgtggcaaggtggagatgatctgccctctgatttgtggagattacctatgtggcctttggacccactccagcagacacacctcacccacaagactggtcaaagaccctggccctccaggatataactgtctccacatctgcatctaagtcttctagccagcagttcctggtccccaagctagctgttgccctctctgtttccacacctcccagcaggcagaaaaacagaagcagagccctaagctgatagcccaggccacaaagagcaatttcagtgaattgtgcaaagatatattttcaaaatacagatcacaagaaagcacatcccaagtgtgaaccgcagtcgtccgcccagtgggccctcaccggttgctcccctgcctgcaggctccgtgcttggtatctcagaaaaccttcccgaggaaaaagcccataagggacaagtcccggcccaacttaaaatcacatcagactgctttccagtagaggagcaaggtcgagattccggcccagggaaatcaccgcaagccctgcgcattgttcagaccccttccccctttgccacttcccgccccccaccccgacctccgaccgattcgcagcaccccacccccagtcggggccatccatccacctgattaactcgccggcagcaactcccagcgtagaaagtagggcaaatgaacacacacagtcggtaaagcaggaagccacagacctggccaatgcacccaccctgttaccaaccccaccccgctgcgcagggggcagccggttcttgatgtggcatttccactccagggaaatagacagcttcctgtaataatgcatgaatgagctttggctgcccaactatcagaacagcccatttcaaacggcatctctgtttcttctcaactccttacttgccttgctgaaacctcatctcttagcccaacagattaagacgaagagagaaagacttattcaaagagatgtggaggaaaaggtttaattaaggagaccaaagagaaagtaccactttgatcacaaaggtagcactttaatatatcagtgcagatagcggcaatgtcagaagtactaggaatccaggtaaatggccccaagattcagcatcaatctaacaatgtattcctcaggagggcgtgtgaacttccatgcttcatccatcctggtgtctccctgtagagagccaccatgaattccttctcatccaccctccatacatcaagtatatgcactcgctttctttttaattttatttttggttcgggagaggaagaagcagtccttaaattggtgtccaatccttctcagacacccgctgctgccaccatccccacccctcacccccttccaggcaggcagcatctaattaaaatggcaagaaagctctgcccccttccccaaaggagtgtgttgggatcgggagttgggggtggggaagcgtcgaagcagcacttggattcctggtattctgatctcaaaacaacagcaaaatggattctatatcagtgatgtcttagtcaatacaatgaaacggcgtctgaggtaattcacgtgaaggtaaacgcaaaccagtggggctggggggagggaggtgctctacaaaggactggccacagacacggggaaaacacacacagacacacacacacacacactcgcacacactccagggagttccggtctgattgaggaaaagcagaaaacacatccctttcacctgcttaagttcagccataaaactgaaacgttacagccacaaagtcagaaagaacaggcagggctgagttaaagccataaataaaggtgagtggcagactggcatttaagggagcgctgagagggcgcccgggcgcgggaggtagaaaagggggagggggaggcagttgccatctacaagaccagcatagcaataactgcccccttggagcggcaggttcggcttcgcggggacagccagcctcacaatgtcatcttgcaggtagctggaaaacgtgaggggccagtgcctttattcacgctggcattctttttgcagaagggacagtcgggtctcgcgccttggcaccagacaactgcccggggcgtgtacacacacacacacacacacacacacacgcacacacgcctttcattttaatgctcttacaccggtataagatgaaactggcataagctctacgagccctcgggagagcctaagccacggccagaggaagacacgtaccgcacagcccctgccgtaggggctcagccaggagcacctcagcaaccccgaatcaaaacgggaatccaggttccctccccgacgcattctcccgctgctgtccccctgccccagccccagcccccagtccacgcaccgagcccattcaccctaacccaaaccactggaaagaaaccagaaaacgtcctgctcaccctcagagccgagagatctatttcatccaggcttcgagccggggagtcgctcgccatgtctacttcttcgctggagaaatggaccaaaaccaccccgaagcttttcccttggaaattccaccttggtctatttcactcgcgtcctcatgcgggtgtcgcgccagaggccccgggcccagcctcccccgcccaccccagccccacagcgccggatcccgatcctccgcgcgtcggtccgccgggtccgggagcccagcctgcgcggatctccaagccccgagcagcggtgcgtgtgggctgagcgccccgatcggctaagggcgctggggctgcgtgggtgtatttaaatgggacatgcttctttgcttgtgcgtggatggcggctgcattggctgttataat

SEQ ID NO: 303 - DNA, 397906 bp, Homo sapiens; identical to SEQ ID NO: 302

SEQ ID NO: 304 - DNA, 397906 bp, Homo sapiens; identical to SEQ ID NO: 302

SEQ ID NO: 305 - DNA, 397906 bp, Homo sapiens; identical to SEQ ID NO: 302

SEQ ID NO: 306 - DNA, 397906 bp, Homo sapiens; identical to SEQ ID NO: 302

SEQ ID NO: 307 - DNA, 397906 bp, Homo sapiens; identical to SEQ ID NO: 302

SEQ ID NO: 308 - DNA, 397906 bp, Homo sapiens; identical to SEQ ID NO: 302

SEQ ID NO: 309 - DNA, 397906 bp, Homo sapiens; identical to SEQ ID NO: 302

SEQ ID NO: 310 - DNA, 113475 bp, Homo sapiens
tgatcaaataagcattttaatatgactttactggctgcacagtaggaatgtaggggctgcaaggataacatcaagggacagtcctgcaggcgttcatatgagagatgtgcaatgcctgtgctaggacagtggtggcagagacagaaaacagaagagagaaatcaggaaccatttaggaaataggatcagctgggcttggtgatgaaattcaggagatgatgtcatgggtgactcctagttggttcttggagttgtgataatgcccttcactcactggttcatttgctgaaaaaaaaaaaaaaagaaaagaaaaatgacaaaaccctagctcaggcaccaaacacatagagcacactctcttctctttgacagccaagctagttctaagtagcatctagatgcctggtatacaagtcctaagtgcctgcagagctggccctcagctgagaagtgcctatcacacacacacacacacacacacacacacaagtaaagagaagccaacaggctacattagattcaggataaatgagctagcccaaatgacttcttctatttcaactccactatcattgcatttaactggtcacacctacaaagcaatcagcaaactgggtgactcattaggattttcttttcaagagagcaaagaacctaaataaagatccttgaatttagcgtacaatacccaggagtcatcggagcagcagcaatttgggggaacttcaagtgtggtatttcggtttgagtggggaagttagaaatcagaactgatctcacaaacaaaaagcttttataatagcctgtcctagataagagagtaatgagaggacaaaaggggaaagccatccccctcttaataccaaggaaacctagggaagtgacttcttaaaaaggaggtaaaagcagcagttttagtcactcatcaagagtgactgttcttcctctttgctagaaatagctaagagagtgtaaatcactcactaggctctaagaaaagaagacttacaaatgagcttgaaaccaaatagtgctgtgtagattcttctaccatcttctaaagaatctgcatggacttacttattcactgttaaggttgtctgtgcatggtagccacagtgctaggatgatatctatagtttgtttttgacaacaagtaaatccattataaacccaatttcttctcttgagcacaagtttaaaaggaaaaaaagaaaagcttttctactttaacatgcctcatgcctgtgcttccaaaccagagcacaagtactccctggggcactcagctctatgccaagtattacagcagcaggaaaccatagattttgtttaagtcaacctttctatagtaatttcattaacataattttaaactgacgcaacaatgattatcatgtggcataaagagaatccatctaaattttaaggatataacagaagattccaaatacatttcatttttgtggtttccacaccaccaccgagtgaagcctttagatctcttgaagaggatggggtggttacaggccaacgaacgtatccattagatgcagacagcacaggacctagagcctacagtactttttgcagtcaacaaaaaattattcttattttaaaattagaagataaaaactaattcttaggccaaagaaaatgttttaacatataatatttgtcttacaccaatgaggttataaagcctaatttttaactttttgttgttttatttttcttggagaaaggggcccacggaggcaaaaatggggagggcctacaacagtcatactacagcaccgggtagtgctttcatttgtgtttgagtccctctcctctgctatgctggtaagcctcaaacacaaatgaaagtgttatttcttaaagtatagtggtccaaataccaacatgatttagtgagacaagggcaaatattttaatttaaaaagtatgtactatatttttaaatatagctgaaaatattgagtttctcatttacggtagcaacgaattttctttttgaaaaatttaagtaaataaaatactttaatgaaaaatattaagcaaaaagactgcaagttctaggatgaacttggaaaaaaaaaaagaggttggtattgctgaatggctgaaaactagtgatatcctagaatcctagaaatactaggattcagactctcagctataacacccaaaaaagtttccatatagatcatcaactaccttcatctctcaagaaaaacagtaaaacatgaccagaacttccaccaccaatctactgggaaaattagaaattttggatagtggtctgagtgcttatttatattttaaatcacatatcatatttttcagaattagtggttcacactggcaagagagcaagaaatatttgttggttggtacaaagcacctccttttactagcccatgaaacaatcctacaataactcttgtattgtacaaagagaggcagatgattgataaagattcccacaagaataagacattcacagaaaaatgagatcagccactgcagtcctaccagctgggataattttacaagggtcagacagctccagggcataaactaatcacttcagggtgaggaagaagctgactcctgattcccaagaggcagtgtcacacaattagattgtttattctagctcaacacaaatttgacacatttccccaaaactgcctgtctagggtcctgtcaaaacaggatgatggaaagtcagaataatgttttagcccagtatttccaacattcctgtaatccattccatttcagtcatgttttgatgtaaaggatattttccccactaatatttgaaagctatccattcttgcgtattctagttacaccgagcatacattcattgtggaataagcagcagccaatggtatccaggatcttctaaaagtagtattcgagggctttttttgtatgtcttaaaattgttaaatctgagtgaatgaacttatctactcccaaagcaagatcttaagttgtttttagtggccaatgaaatctttcccagggagctagaagatgggctacccaaaggaaaatattctatatatttttcaatgaacatatagaagaattacagaacaaacaagacataaaatacaacattatagcaaatgtttttgaggagggtgaatgagattcttaattagttcttttgcctctgccaatattgtctataccattgtccttacacaatatttacacaaaatattgcagctaataagcagaatcaaaatttgaactcagatctgcttagatccaaacctatggtcttaacctctgtatttgttccagaacagttcctggaacaaagctggtagccaagaacaaacctggtagccaatccgtatttgttgaatctgaatctagattaggaaccaggctgtttgatccaggattctgaggtgtttctagagctctttacaactaatctcaacacccagaatgaaaaagctctctatgacatttgaagatattagatgactacatctgataatgccacattcaaatattttctgttaattcttctccctgttgaaatccaattagcatgaggaaaattaactactgcaattaagaggaagaggaagtgaaagatttccatataacaagtttaaagctctgttgctaaaaaaaaaaaaaaaaaaaaaaatgcccaaagaaactcaatcctgtaactgaatttcagataacagagtatactgcatacataaaaactaacttttttgagtactcactgtatacctaaaattcttctaaatgccatttcatgtattatctcatttaatccttatgagctaggtactattattcctaaatttcagaagagaaaaccaaagcacaaagaggttaagcaatgaagcctaggtctaccaataagtggtagagccaagattctggtcccaagggatacaaccccaaactttatgcttttaacctgctgcttcccataataataacacttgctggacactttaatctgtctcatatattcttttttcttaacctccacttcctgggttcaagctattcgcgtgcctcagcctcccaagtagctgggactacaggcacgtgcctctacacctggctaatttttgtatttttagtagagatgacgtttcactatgttgctcaggctggtctcgaactcctgagctcaggcaattcacccacctcggcctcccaaagcgctaggattacaggcctgagccaccatggctgggctgccctatgtattcttcatgcaaactatgttatttactttccccaacaaccatagagaaaatatatatatatatgtatatatgtgtgtgtgtgtgtgtatgaatgcatgcagatataggaggtgtgtatatgtgtgtctgagtgactattctctatcctatcactgtaaaaacacttgacagatctctcaaccattgaaagaaggtcatcttagatcttctatataattaatcaaaagaactattcatacaaaaattgcattatgtgtcatcttcatttttcattaggtattttgattggatgttgtttttgagaggaaaagaattcatttattctcatgttcttgttctttttctcattttaatatgaaataacagcaccagagaaagttccaaaatatcttgaaggacagagtttcagggctatcattgcatttgtaagagttgggaggaaaatttccaattcatagtagtagccaaatgttgcaaatcttcatgtaccctccacctaagtattacagactctgcatcatgtaacctggttactgccagaattgagatctcccttctcctcttcacttatccaaatgtgtgattcatctctgtgggatatgacaaaccaaccacactgggcaaaaaggccctgcctgagccctctcagttcccaggagaaccattcaacacaaaagttaaatggtgcatttcaggcaccctgcccatcctgaaccctggatttatgccaaggaaaggcattccactaatcaagctatctctagtcctcaggaccaaggagatggcctaatctcatgcttcccaaagttaaatgggcatataaatcacctgggagtctcgttaaaaagcagattctgcttcagtgggtttggaaaggcctgagattctgcatttccaacaatctcccaggaggtgctgatcatgctgctggacagcaggccacacctggagtatcaagggtctagttcatacacaaatgcaaaattgggcttcaaagagaagtgtttgattttttgaaaggttcatcctgggttctcatccagggtgatccataaaattttccatatcttcatgtggcattaaaaactccagacaatcctcagaaaaatctattcaccttttaagcctttggattccacaaggctaccacaccccaagtatggagggagaccattattccatacataactttaaaggcatcccctttgtgacttagccacatgttcttttgtgttatttatccaaagaataagcaactgataatttcagattttccaaaatggcgaatgtttgacataaatgtgtttaatactctgcaaagcctctccaactcagtgtatttgggatgcaagggttggtatcactatgtaaataaggaactactttacagtacagtttaatgaaccaagtacatgcaggaaccctatttaagtgaaagtattaattccttggaggaaatgctttaatactgaagaatgacttgtgattagcatatcaacaagaataaacagtcttaagatacccaagggtacttaaggacagaagctttcaacaaacttcttaaactcctgtttatactcttaaattgcttggtaaacgcctccttctaaggtactttaaaaggtcaagttttgcccaagtctcctctctgaaaactaatgaggctttaatgtattcagaaatgcaaaagtaacatcaaagttatttgattgacccaagccaaagaaccttctagaatagcaacatattttggctgggtttctaccttaaagtcacctctcctcctaaataggataatttaaaaaacatttatttcaacatattggcagaattactaggtcatttgtgagcagaataattcttttctacctttttagaatggtcagatatgagaaacaaagcatgtaaacaacactaaaggtggctgctctactttacaaggatcctaagaactagaaatagtagtcttcagttaaaccagaaaattttaaattaaaggttagatgactgaactcttgcactgagcagtcgaccccaccatgctttcattatgccaatgaattatatctgtttcaatcactggtgtcaaaaggttgtgggttcaactccaggttgtgccacttactgtcagtgtgacctagggtaagttaaattttgcaaggtttagacttttcatctgtaaagcagggatactaagcagtaagtgcttactttatgatgttgcggaagcctgctaccgagcctttcctataatgggcatagttactctatacatatactatacatacgggattacatactattgctacttttactgtgcacagaacaaggtcggtccttgagcttttaaagagacacattaacaagtaaagacaagaactgccaaccaaagcacatactaaatctatgaaacacctgactacaagagatgactcaggattaaaaaaaataaagagatggctcttaaactatcaagagttctgaactcatcttaacctctgaggttcaagtctaggaagacagcaatattcttctgcaatgtgaccttccacatgggtgttttgcctacaaatcaaagtttttattttggatgcccagccttcatccaagctgagttaaaaagttaacttattttttcttctcttagtaatagtaggcagtaatgattgtggtcctggtacttcttcagagttaatatctatgatttcttaaaatgtttattctggagaattttttgtagatatcctctaccctccaaatgcccccaaaaggtgtatgttagtataaagtgccattattctagcaaaatcagcccttaagaccacattcatgtcttagggtgacactgcgctaccaagaaaaaaaaattttcttgaactgataacaatttagaaactcactcccagtaaagcatagaactcagcacaaacaccaaattcattatatatatgtaatatatatgtagatttacacacctttgtatagctatccttgttttaaaaaactaattttcagcattaggcactttcactgcttctgctctaacccaaattgctgattgtaaaaaggggattttctcccctgtatttactttggaaacagacaccagccacggagaagtagttgagtgcaactgcccacagactcacactgaaattagagcacctgagctggtccactacctgagccgtgttcctcaaggaaatttcaaaagaaaacctccaggacctcggagggccaaaagggcagcttgtagcaggactcggctgacacaagactaaagcctaggagttctctgtgtccttacccttgggcttcctgagaaacaagatcctgagtcagacactgaaatcttatgattatgagcaaatgggcctcataatcccaattaatctccagagttgattgttagaaatgcaaagatactccctagagactgttgcacagactaaggagtttcttcaacactgagaatgtagattaagactgctgagggagaaataatttaagtagtgattgggctgtgaaagaaaacattgtcaatacctatcttacttttagctattcacaaatatatagatttcagagagaggtaacaccatgatgcatagtacttaggccaaatttcaaagagcacatctgaccatagtattactcatcaacttaatcaggtagccataaatctcctatgcttctagactagaaaacaatactcaaagagcgttctgttttcaatgttgctattctgttttgggttctgttagcagacttttttttgtttttgtcttttctgtcttgtattttcccccatcccctgtgaacactggattcttggtcacatcttaatttatgactatttactcagctgattaaccgtaggcattcgtcttattcaagcaaatcttgttctgagcaacagataaactggaaccccaaggacagagcagccatggctccgtattaatcatctgctcatcccatttccccatcctacagcagaccatgaaagctggggttgcctcagagggcttggcttcaggcacctcctccctgaagcactctcagaggggcatattcatatggagcaggagggaggctttggtgattggcttctgtgataggtttcttgagggaatggaaaggttttgaagttctgaagtatttgaagtgtctcttcataagttcacaagtgggtacaaaatggtagaacaaaatgtactaaacatttaggccacaaaacattcattttctccagctgaaatcaccagaagtgttagctggggagaaatcagaatctgcctaatttgcaactcttttgaagagaatataaaatcagctttgcctccacccaaagaagaggacacactgtcctgttttcactaactttcactattttgacaaagagaaagaatgagataactctggctaaaacttgtcatgaaagtatctgatagaggcatctctagcattcctgggttactgatgttatataactaaaacctgtaaggaaaaaagtgaataatgtgatccttaatggaaacggaaatagagagtcacaggtattcctaacttgcagtcatgcaaattatccaagagattacatctcggtattgtagccaggtcatcctcctctacaatacccagaaattctttctttccatcctctatttcattgtctctccccaccctcaaccccaaacacacaaacctaggcatccctgtaaaggaggaaatataaaagcaaagagtaagcaacttgctacaatgccacaccaggtaacaggtaactggccttccccctgcttggaatagaggaaaagtacaaattatacacctggcaaatatttgcgtggtctccagagcagtaagattcatccatttgctcacaaaatcacacaactgaagctgagcgaataaatcaattcaattcatttcaacaaacatttatcaagctccagtctgaatatagagtttttctggggggaaaaaaaaatcataatgcacctggctattggagctgattttttaagaagtctagaaatttcttcctcctttctgagaaacgaggcaaccaactcccttaaataatcaacacagatgtattttatattgtaaaatgtaagtagcccaaggtatgccgcttccttttttgtaggtggaaaagaatccacttcttatctttctgggaaaacacaattgtgtttgttgtacaaaaacacagtgtccccatttactaagaaatcaatgagtaatcaccaagccatgaatcaccttttagtatttttgctataaagatgagaagcactatatattgaaacaggctatggcatcgctgctctatagtataaattcagacttatcaagaatctacttaaaatattctaaacatgcaatggaagggcagggcaaaaccaatctttgccaaacatttaaggagatgttatacacaaatttcctcctgggaaacttctgagtggaggtaagataatttaggcgactcgatcaggagtcatgctctactacttacctgggggcttcaagggaagacatttataaactctcagacctaaatttctctcctttaagacaaggttaatcatacctcttctatctaacttatggggttactgtgaaggtcaaatgaaataatgaatatgaaggtttcaaaaccattgttttatgttttatgattgatatcagtgatgtcaacgtttaactctacagtcccaaagacatggtagaagatggaaaacaacctccaaaaacccatctctgatatcaaaagtgtgcaatgggctatttaaaagttcagatgagctgtggttctttgtgcttagccacaaaaacagccttagaatcataaagccagttttaaaaagaagggaaaacaatttttttctttgtcctattctcttctgtcatattagatggtaggcggacactgtttttacttatcaggtatcaaactgctgttggctactaaatattatattttgtgtcagtctccttaatttatatactcaaacagttgagatgaagcaaacctaaacatatctcactgagttagggcattccaaactcagcagaatttttttttttttttgagatggagtctccctttgtggcccaggctggagtgtgcagtggcatgatctcagctcattgcaacctccatctcccaggttcaagtgattcttctgcctcagcctcccgagtagctgggattacaggcccagaccaccacactcagctagtttttgtatttttagcagagacggggttttgccattttggccaggctggtctcaaactcctgacctcaggtgatccatctgcctcagcctctgtacttttttttttttttttttggtacatatttataactacctactctgtattggtactagagaaacagtaaggtaatgtccctgactcagtttggaataggagacagccagacagaggattacaaacaggtcagagtacggagagaagaggcagggaaaaccatcaaaccccattgggcaggtgctgcctgaaccaagtgttaaggatatagtatggttgctagccaacagggggtgaggaagggcacagcacggataaacagacaccgtgtgcagtgtgcacgaatgccccgcaatgtgctaccatagatggacacagtgggaatcaggatgggccgtagatgaggctggagggggaggcagaggtcatgtcataggaacctgtgactggggatgtagaactgtgctccctggagctccaagtgtggggctactctgtggagggaggtagaggtgcatcggggagtgttgtgtcggcaaagggacggctccatgaggtagatcctaactatcctcccagaacatcctgctattgtgtcaaatactggagtttcctgtgggggaaaaatgttttgctgctttaaaaaatagttgatacatttaaggtaaagagaaatctcatttgtaaaattgtaataaaaataaccacagcccagacattttaatatagaaaatgtattagtctgtttttgcactgctaataaagacatacctgagactgagtaatttataaaggaaagaggtttaattgactcacagttccacatggccggggaagcctcacagtcatggccggaagtgaatgaggagcgaagtcacatcttacatggtgcagacaagaatgcttgtgtagggcaactcccctttataaaaccatcaggtctcttgagagttattcactacacgagaacagtatgagggaaactgcccccaggattcaatcatctacacctggccccacccttgaccggggattattacaattcaaggtgagatttgggtagggagacagccaaaccatatcagaaaacatacacaatattcttttaggattcatacaaaatgcttgcgtattttttgtggacttctacctgagaaggatcgttttatttagatataaacagggtagaaaaatcaagggcttcagctggtttcagcttcctagaacaagatgcagccctgcagttgtggggcggtcagtcacctgcagataataaagtgggctgttggtgaggtaccttggaggaacgccaacgtaaggacagacagacatgcagacccatttcaagcttgttgcagatccagtgttgcaggacatgacccaggaaaccaccacctctataattaagttttaagtttactaacagtatttttttaaacagagatcagggcatggggtggagtgagggatagtagggtatggggagttaatatttaactggttcagggtttcagttgaggatgatgaaaaagttctggagatgggtagtggtgaaggttgcacaacaatgtgaatgtacttaatgctgctgaattgtatgctcacttaaaatggctaagggggtaattactgtatgtacgttctacgataagagaaagaggtaccactaaaaagatttccagtaagataaattcagctaggagcctcataccacctccctgaatgtgatgcacagatcaaaactgaatttctcaagccatactcgaagtatcaactcgaagatgttaaacagtaacgggcaagttttctaaaacaagaagtcaccttctccttaaaggagactgagttcttcacatatggagttcctaactcttccctgctgtccacaaagatgatatggttattattatcatgattgttgtaacagacattttgtaatttatctagaaaaattgtgtaaccagctgctacacttgtctgcctttgttgtagagaggaacaaaatggacacagtagttctgtgcttctccttgcaaagtgagcaacaggaccaagatccgaagcaatatcagaggccactgcacccagcagcagaggttgtaatgaccccattctagaccctcaccaccaacaacgctcctatgtagtagtaagcatatatttgcttgccgaacagcagatatttctttttgcatatgcaaaatatccaagcagatttaatgaaattatacttaaggttaaactacagagataagaaatacaatctcaataccacagttaattggttattctttttattaaagagtctcaaatgtttcccatgtacaaaatagttaaaaaccgtgaagagccctaaattctgtgcctgtaatcctggcggggtttcattttacaggttacaaataacccagaatagtaactattgatggtttaattacttgaaagtgccttataatcacgaagtcattaagggtgttatgagatctaaaaactacaagtcatgagggggttgtgcatcaagttatttggcaactcattgatacaatatgaggtggaatgaaagtattttggactaaagcattctaaatacttcaaatcaaaattgagcacacgagtgccaatccatgtccatccctaacagaaaatctcatcctcttttcatcactattagaaattttgtatcatcattcactgaggcagtgagaacctgctaaaaccttgcggctctgaattaatgagagaatggtataaaatgtgcatgtgtctacatccttcaacacatcaactacaccaagcaatgccaccaggccacatgggtaccttaataatgttaggcattccgtataaatcattttgctaatggtttagagtattgctgtaacagttttgcagttggaaaagcacaggctgtaagtggattcatggaagcaacttgtggaggttatccagactagtgctctacttagaattaaaggatgtcatatctagaaggaactctggagaccctctagccagacctcttcgttatacatgaaaccaaggcccagaaaagctaaatgacttgcttaagctcacacagctaatgagtctcaaggccaagactcaaggccagaagagccatctgtccatgtctgtcttaaaggcttcccagccctacttcacctcaggttattgaccctggcccaggccatcaaaagcagtcaagcctttggtaacactacctctccctagagtacctacttaattccccttccacatacatctattcatcttttaagactccactcaagagtcacctttatatgaaggctttcctggtcttcccacagcccccacagatttggctctgctctgtatactcttgctgtggtgcatggaatacaacattgaagtgatctattttcatgtctctccacccagagacttcaaacccttggagggcaaggaccatgccacatgtttatctataaaccatgccctgatggcaatgccaggcagttgttagatacttatgaaggctgacactgaataaataaacaaaggtaaacaaaaccccaagatagagctaaaaggggtagactcatctccaaagacaaagatacccaaaagagcacttacactacagacagcctcagcccagcagctctctatcctggctgtgcattgcaagcatctgggaaggtctggaataaaaccttccccagcccaacatcagacaaaccaaaatcaaatttttaaagaaaggcccaattatctatagttttgcaaaattatccagatgatttctataaaaagtgaaggctgcgaaccactagtagcaataagaaatcccacacagtccctgtatcaagttttggtagcaactctacaggttcaactacctagtagagcaatcgacccacccatatggcatctagcacacaggcacccacgaaggtcttccctccatgttcacatgacaaccatctaattcattatactcaacagatcatagcacaaggtggcatggtcttcagacaaattagatgcaaacaacttggggatctatgaggatgaaaaattcatcaagccaacatatttcaaaggtgaatgattctcctacttattggagaatggaagtaaaattgttacctttaattctagcaaaactacactttaagaacagataataaagcctgaggatgaagaagagaaataacaacataggaataaacttccccagaccccaagataacaggaatctgccacctcctattgtaataaatgacaatagcagtaatcaaaccttacatgtacataggaatttatatttaacaaaatactttcatagtcattaattgatttcaacctcacgatagcttcatgggttatatcatgaaaactgtttctttatattctaattttacagatgagaacaactgaagttccaaatagatctatggcaagctcaaagctaaggcaagttaagggtagaaccaaaaccatacaacgggtcctcaatatctaaatgaggttcttgctgctccacaccccttcactaatctcacaataaagactctctcctgagaccttatgctacctgaagaagaaatactgttgcttctcctccaaaacttgtgaaatataaaattattcagaaaccattttcaccccaccaaagttccacagtgctgcaactgattcctgtttcctctattaacctatcttctctttacacattattgagacattggcttttttaagcactaaagaccaaatataatatccaagtggcaattatatcaccaaatacaatgtaagaattgtattaggttggcacaaaagttactgctgtttttgccattaaaagtaatactggtattaggttggtgcaaaagtattgtcgtttttgccattacttttaatggcaaaaaccacaattatttttgcaccatcctaatatttaatacaaataatgccattctaagcatacataaaaaccaataaatcaaatgtagaatgtggagcacaaagacatgtgtttctaacttcattcctctatgaatgtttcttttaggtcataaaatgttctatgaaagcaagaccatgggaagaactggcacatgtgtttgggaagaggaaaaggttattgagtgcctactatgtgtcaggcactgagctgaatgcttccacatattaatgttttatacttgagttttcattaacagctctaatctgtactattaataaaagataaagaaatccaggctcacagggtaagttgattatcttcacatgactggaacagagcaaaaccagactaggaatccagctcaggcagtcctgctccaaagtccttttcattatactctttccacttataaaaatgctcaattacactcccagatacagtggaaatgccaaagcctctaagctttttccaaacccacatcttgtgcccattcaggtccccactctgcctggacagcattaattcctaaatagtctacactctcaccatccccacttgcacctcaatgttaagagttttgccattctgtgtgatttttagagcagtggttttacccccacagaagacacaggaaaaactggagacattttcagctgtcacaacttaggggtgctgctgctttgtagttggatgaggccagggaggctgctatatatcttgcaatgcacagtacagcccccacaacaaagaattatccagccccatatctcaggagtgctgaggctgagaaaccctgccttacagtgataatgtgatttaataaatgttcttcctccccagtaaaatgagaccataaccaccatgaggaataactgagacaatatacataaaaacctctggtgcacagtgaacactcagtcctaattagataatctgattacgcacttcttaagagtaggaacctcctcagttagctctgcattattcccatacaaagcacagggcttttttcatgggcactcaacaaatgtgaaagaatgtattctttatgttagaaattcttgattaaaaaacaaacgccactattatctataaaacacaccattctcccatactcactccttgccaaacaataagtgaatagtataatacatgattcattgcagcaggctatgaaaagctacagtgcatccaggataatgttatagaatcacctccataaataaactattaataaacttgctattgaaatgttttatcttattttaacagaaggttaatgaagagatcgtgatatacagatttgagaaaatctccacccaacaggccaagattttgctatataaggtcagttttgacaatattgattctcaggtcttgagttaaattattcagctttaaactgtaatcataagcatatcaaataaaaacactgaaagtcaaatctttgaataagccaaaacaggcgggtatcacatctcagggcaagatctttgatttttgcttttctcagtttatgtaagtttgagtcagcatggaaatcctaaaataaatgattacaaaaagtataggattagcattcactcaagtgacctataacaggataacatacaatcatttttgcagtttctggaggtgcggtcccaggaccttgaacaacagaatgagcatttatacttattaaatgttcaaagaggataccccagacccactgaatcaaaatttcagaagttggagccgggaaatctacattttaaatcctttcccaaatattcattttacatactaaagtttgaggacctctgccaggagaccagaccccagaaaattgctttgcctcattttgtaaatttctagcatagtcttgcttctgcagactactggtaattcattaaacataagatccacatccccatcccattataaaaaaaaaaaaataggtagaggattttgtttattgcttttgtgcaaatatatttttctaaagtacaaagattaacattttatgaaaatgctaaaaaaaatttaaaactgggaacaaatatagaaagaattatcaaggaaaacatagctcaattctgggccccagaagtgtcaacatttactgtgtgccagactagggatagtgatggcctagacagactaggtctctgacttaattttcccttgacttatgtatttaaattgctaaatacagacataaacaaggaagtaagataattcagagagtggcaataccataaaaacaataaagcaggttaatgtaataaagaaagtctatggcagagggaagcagaggcagtggctagctgtaatagacacagggatgaaaagtggcttccttgagaaggtaacatttgagctgagacctgaaggagaaggagccagccatgagagggctgggggaaagtgttctaagtagagggaactatgactttaaagaccctgaagtgagaacaaggtgctcattctaatatagaaattaaataatatattcaaaaggttttatggaatataaaactatttacaagcataaaacacgacttttagtgacagaatagttcgtggggataatgaagggcctcagctctatgccataagaatgaatcaagcaactgaggctacattgcctggacaacaggagatgtaagtatatgtttggaggaagaacggagaaattttcttcaaatatcaaaaggactacacaaaaggactacattcttttttttttttttttttttttttttttttttttttttgagacagagtttcgctctacttgcccaagctggagtgcaatggtgcgatctcagctcaccagaacctctgcctccctcgttcaagtgattttcctgcgtcagccttctgagtagctgggattacaggcatgtgccaccacgcccagctaattttgtatttttagtagagacagggtttctccacgttggtcaggctggtcttgaacccctgacctcaggtgatctgcccacctcagcctcccaaagtgctgggattacaggcgtgagccaccgcgcccggcccaaaagttctacattcttgtgaaagaatatttaattttaaattttaaatagctctagaggtatgaaatggggttgaaatggtaaacattttaagaaggcaggatctcagcacaatgtgataacattcaaaggaactgcaggaaaatggactgacagaaaagtaatgagttccacatgactggaggtcatgaaggatgggctgaacagccagctggcagagaactcagaatgaggactatgaagactcttatagcatgctggaaatatacacactcacagcatctgtctctcttaagcacaatagccaccacgacggcctccctactttgcactttacaaccttaagaagtattgaaaagaaatatgagaaatactgaggaatccttcatattcctaattcacattatcaccctgggataaaatatgtcttcatttccgtaataaccaatctatattcaaaagggcaaattaggagacaggaaaaaccaacatttatttaaaacctgtggctaatttgtagtggtatcttaccagtaaacattaaacaattatttcaatttattaaaagaattactctattttaacaaaaatgtgtccagattccattaggttcccaatagatggcatgccaataaacagccaagacctttagtaaatgggtatgtggccttttgttggtttattttttaatgcagccatgaacagaaggagatggtttcctcattaaaagtcctgagagtgaatcactattctttattatttacctatgctcctcggtaaataaagcaaaaaacagacattgaatcactacttgattagatgggactaaaatgctaaagataaacaaatctaaccttgcccaaaacaggaataagctaaaattgggagtaagactagaagcaactttgaaaaactaaacattattaaatggcttttatataaaatatttatatttctatatctagatgtacctgactcacatgcagatatatttcaaggtgttctctgaatacctacatatactttttatttattatattaagtatgtttctttaaaactacctgtaaacaaaattatattatgactctcttagggcagcttataaaaaagaaacttataataaatttttccataaaataagggctatgtccatatacttattcataaaattatacctgactttatgaaaaccaggaatgccaaaagagagactttaaaaattaaaatcaaaggcttagcatttgatatggtttggctgtgtccccaaccaaatttcgtcttgaattgtagttcccgtaatccccatgtgtcatgggagagaccaggtggagataattgaatcatggaggcggtttcacccatcctgttctcatgatagtgagttagttctcatgagatctgatggttttataagaggcttccccctttactgggcactgattctctctcctgccaccctgtgaagaggtggcttctgccatgatcgtaaatttcctgaggcctcctcagccaggcagaactgtgagtcagttaaacctctttcctttataaattgcccagtctcaagtatttcttcatagcagcgggagaacagactaatacagtatttaacagaaagaaaatacttatcatatgattttatgtataaggacctcctcctagagctataacatttctatttatacctacagtattttagaaacatacatattccataaaagttgcataatctatagtgcaatcactttttaatgtaatttacttaggctcacatatcttttagctcgtattttgctattttattaaactttaatcttttagaactcagaatgacagcaggactggattagtggcctcaggaaacacagggtctgctcatgagcagtgccacctaacatcgtctggttgcctagaaaccaaacccttaaataggtaggtagggagttataattctttaagtaaatcaacacaaggccccatagcatttttttggggggggggggaggggacagagtcccactctctcgcccagactggagtgcagtggcaagatatcggctcaccacaacctctgcctcccaggcttaagagattctcctgcctcagcctctcgagtagctgagattacaggtgcatgccactaccacctggctaatttttgtatttttagtagagacagggttgcatcatgttggcctggttggtcttgaaatctgagctcaaatgatccatctgccttggcctcccaaagtgctgggattacaggcgtgagccaccgcacctggccaggccccaaagcatctctaactacattctcatttgactaatacacagaaaagctgtggtggctacaaaacaatggggctggtaaaagagagcaaatctcctgtcccaaagttcactgcattcaccatgaccattctttgcagaatctcccttaaacttggaaggtgccatagtactgtatcaaccaccaagagaatggaatcctttagaataataatgttgacaacctagctgctaaatatcttccctctctaaaaagatctgagacctcttgccatttgtttccttgcctttttcaaataacaagaaattatggataattctggattttccaaatattctcatccttaattgaatctcttggtatctcctcttataagactgcagagtttcacctcttgaattagtgtaccaagctgtgaaatgtctcccaaatgtatattctatgggtgggaaacataatgaaacggaaaggctctaagaaatggcaccataaaaccaacagcatgctacagagttgctccttcatattgacagcaaatcagaagtaattttgtacctaagtcagagcttaattcattagttacttcacaagttcaatccagtttctcaaaatgcagtaacacaatcttccaacctaattatcttcattgaaagtatttaaaagcctttgctgagacacatttctttctgtgtcagacaggatcaacgtcaagtgagcaggttgggtagactacattctgtctaatggtaaaaggtgtacaatttaggaaataatcgtttcttgcaagggagaattttcccctggacaccaaaggaaacctctcgtaaataaacatataaatgtgtatccacttagaatctcgagaataccctataaataatacttttgacattctgcagaattgaaaatattacaacctgaatgatttctataataaatttaattaactgagagaagtttagggctcaggaggaatttttaaaaatagaacacgagataatttgtaatggaaatgccatcccatatcgctgccactagggaaaatgatggatatttccctagaaattatcatgaggaaacagttggtttgttttgatggcatttcaatagctcattcaatgaaaccccaaaagtttcagtccaaaaacagttcactttcattttttttgtttttttttttgacaatcagaaaaggaatcaactcacattttcaaccagccatttttcgtagattatacttggggaaaataccttttaaaaacactttttgagtgaatttgtaagcagaaattagtacacaggcaagcaagacttcttattccacagctcagtctcaactcaagtttaacttttaattatttcctaaaattcgtcgctgctattaagcttttgctttgtgaggtaacccagttttcttccaacactgttcactccactcatttaattcatgtcctaggccaataacacatctacttttccagctgtaatagtttaatagcttaaatttctgaagtagatggcattcttttctctttcaaaaaccagttctggcagtgattaagtaaaggaaactgaacgcttgaagagcttcaaatatgtgccatcagaattcatgtgtcacatacaaacacagtaatatataatgaagggaaatacccaaatcacagaatccagtttaagcaacataaccacagatatattttaaaagatggagagtcaatcaacaagtatattaattcattttaaatttgttaggagccatttatgagccagtatagacagcactgcaatttgtcattcatgaactgaaaccgtacataagccactctcagactcaatgtacttaccttataaacttgcccgtatgttccatttccaacaagttccaccaattcaaagatccctgcggggtcctgaaagaaaataaacaaacaataaaaattcaaaacaatattccaggcattgccttaatcaaaagcaaatacttatttaaattaagcaaataaataacaactttagcttcaggggctctcatgtgttaacatttaatactatcaaaattttaaaatttaagtcagctgcagctatgaaattagccaagttctattttctttccattttacatttctatgaaatgtgtttaaatcaggcaaaaggagatgctttttcaagtgaaataataaaaaagaagtaacacatttctcactgttaaatggaaaaacacacttgcaggagctacagcaagataaagtgaaagactcatcatcctgagaaggttctaatgttccagggtatttctctttgaaatatccgagctgttcattgtgttgagtgagccctggtagctaagaagggtgttcgtgcattgtggggcaatcttacctatggtagtcaacagtttccaagggaaaatagagtcaacttaactacctctctcagaaagtttttctttggattcatctcttctgtaatactgcctctacaaaatatacttttgaggatagcctccagttcctgcagtacctgctgagtaactgcaggatttagaatgcaaactaaattggagaattattcaagttcttaccaccaatcagttgtccactaaccccaggagtcagctaaatgttacagcgttcaataaatatccaaaattactgctattataactgaattactatcccaaaaagttgaaaagaaaaatcaaagccaataaaattctattcagaggcagaaattgactttcaccccttactgattcctaactggacagaaattgcttctttaaaggcataaatctaggagtcacaaacttaaatgtctacagaggccaggccagtaacataaacaagtaaagtggtccagttggggcctgtggcaaactgggcaacccgagcctccttgagggaggtagggtatggtatggtagggtggggtggggtggagtttacttagctggagccacttgttgtcttgtcaacatatgagcacaatattgccaggtctaaagatttttcaagagaaactgaacattgtatttaatgtgagatctcctattttttaagttttaggcacttaatttaaaaaacattcttaggaacaaataaaaatagactgcgcctttggcctgtctctactggacacttacataagagcaatgccatatattattacaatgggtggctaagaggcagggagggaacagcctgaacttcagattcagagagacctgggttaaataccagctgtgccttgaccagctgtgtgatcctaggagaccccgagaaagcaacatattgtctgggtctgcagggatgacatctacctagccatgctcttgtgaagaataagtgtgggctttgcacaatgcctttcaagtagtcggaaatctattaacacctaatagtaatcacttttaagctgagaaattccacaccaccagcaggatttaaatgggggaaggggaaaatgagtttatctgctattctggggaaagggaaaaatgagtttgatctgacaagtcaggatgctttaaagtccaatctgtggtaaatcaaactcaagaaaagcccctgcgtaggtgccttcaaagattccacacagagaacaaataaaaacaaaaacaaaaagcaaacaaagcacccaacagattaagcacttagtcactgagaaagattggagttagcactacattacctgctcttacaaagccagaagggcaagaaaccacactccatgctcatgtcctgaaaaatccagaagtccagaagttccagttatgccccacctggtctgggaggtgtggttccagacagaaccacaaaaccggaaaacactcttaagggacttagagctctgagtcgaccaacaccccatagttagaagacaccatcaaggccacctgggaggcctcaggatcgggaagaaaaattttgttggttaaactactaggccattagagcagcaggttttattacaaatggaattagaaagaaatgaggaaaagaaaaaaaaagcccataaatggtggcagctgctgtttgtttctaagctgtgcttcccagtagtttgtttgcttggtggtgtttctgcaacatatttggagagaagtcctacatttgcttgaaatagctcaattgtgttttcaacattcatttttcttaactaaaaaaaaaataacagaaagagaagagatacaggacagtgatgagtggctgcctcaaggaacctgggaatcaaacagggatgtgagatgagggcaggagcacaaacaggtgcagagcaggaatcagcttctacatccaaaggtcactcgcctcagggtcccctctcagagctggggttagtaggtaggtctcaggaagatctggacagctgacttgtgaggctcttttctctccttgaataatctattcttgggtatatgtcccaaccaatcaaaaccaaggaggcttaatgctgagcctttagttcaaactgctaggagaaggtttttgctggacacatccaagggcctcagaagtaaagttcagaggaactaaagagttctactggcaactggccttgcataggcaaccaaactggaaagaatcatcatatcagatgggttccccaggaataaaacctgagactccctgagatttatactgtgtgagtttattggggtatgcctcagaatcaacacctgccggggagtaaaggaagaactggactgagccaaaggaagagctgaactgaaatgtagtggtaacaaaaacttcatctgatccatggaagtgctggagctaggacagccctggagaattatcctacctggaagcatcaggactttgcatcccatctccattgactagtcactgcatgtgggatgccccccaatacccgtcccagaggtaacaatcttaggtgaactgacactgttcagctgaggacatttttcagatgaacgtcatccctagctacctacactcccagaaggtggacaactgagtgcctcagcagtggagaactgagctctgtgtgacataccacaacatacactacaagcaccatggctagaaataagaaccagtctggaatcaaaagagaagtctataagcatctacagtctacagtatcctgagagtaacaaagcaaaatagcatgagtcatggtatttgcaaggagggggctctttgaaaccctagatatggaagtcagaggtattattcagtgacacctcagtactgaccctaggctctcttctctctttcccccaatccaagcgcctggagagctgaatgtttgtgaatagtctttcacacaaatgcatttcatcattagttacatccttgtagaattgtgatacagcttgaacagtataagcatttagctgttttctccattctagagtacctctaaagtaatttccccaaaaggtcaccatgaacctcaatttcttacacatagtggttgcttctcagtcctgtcctagttgtcccttttgaggcatttatactcctgagcatcactactcctgttgaaaatatatccctccaccatcttctatcatacctcttagtctctctcacagattctataatatttcttctgctcacaccttctaggtaccttcccctaagtttccacccttgtccaccactcccctaattttgttcactaagtgtcaatgatcttatctccaaatgtccaccatatccatctactccactccattcacacaacaggcttcatcatctttttctgggaccatttgcttttagttaattctttcttccttctaagctattctccatactgatctttctaaaacagacatttctaatcatgacactccatgatttaaaataatacaagatacggttcaaactgaaagtcaaggtcatgtcattcttaggcctggcctcgattcccagccttgtgttccatcattctgtactataaccaacacatgtccctcatgtccctaacataccacactcagctcttggttcatactgcccatctgccaagattattccttctgctttctttatgaggcaagcccatccttgaaagcccagcttgctgcctcctttctgaagcccttcttaaatcagcgtcactgcctctctctctctgcagccgcaatatgttgtgcacagctctatgataaccattttcacatagtgctagcctctcttacatttctctcccttgatgaattacaaatgcctcaagagcaagcactgtaacatatttatcttggtatttccagcacttagcatgctgtccaatacataactgctagatataactatttactgaataaggttgatgtcccactcccaattcttcaagacatgtatagtgcaaatcacaaaaaatgggatcagaatgtagagccaaaggtctagcaaacttacatcatttcttttaaatctagacaagttgttttaccactgtgccctctatcctccttaccccaatcccaaatggacaaaactgtcacatgtaaaagcccctgtagtattcccagcttaaaaaaataaaatccatagagcctgttgtagtaaactgtgcctcacgtgcattgagaagacaggctgtcagaatgtggccaacagaatgtgcagcaaggagaggaagctgtacctaataatcatgttacaaagacaggaaagctaagagataagaaatccacttaattctccctcttgtgtttgcttagctgctcttaaagccaggatgagcagcatggaagaaagttacatacaccaaggagaaaagagcaaatcattgacatttaccaaagtcaagaatccctgttggccacacatgcctttattcagatcttaacctttgctgggagggtgagaagagaatttaattctaaggtagagtagtttacattatttcataatgaaatataactacatatcaaaaggtagactattccttgaaagaaaatgtaatttttcagccagtactgataaaagcaaacttggttagtcatgacaataaaaattacagtaatagtgaacatttcatgaggacttatgtgtcagaaacgattctaagcatttttcatgaatagctcatttatcacagctttatcaagtggatgctatcattatctttgttttacagattaggaaatggaggcacggagggattaaatgcttagtcagggtcacactactaatgagcggcagagccaggatgttgactcagatggtcagactccaaaccttgagttcctaatcactatatcatagcttcatggaaccataatccccagcccttggtttaccacctggtagctctctaaccttgagccagtttcagaactgcattgaacctcagtttcctcatctttaaaatgtggacaggattacctcccttgggagatacaatgagaactgtgagtgtctagactagcttggggcctgatatgtaataggactttaataaatattcattttcttcctcccttttctttttcatctttgaaaatgagttcatgtaataaacaaagaatatgccacagtaaaattcagtccgcattttatagattttcaactaaaaaagccaataaaactaatctggccagtaaacgaaaacctattgcttttcaaccaataatattacccaccacatgcttagcaaacagagtcaggtatttatggacaaaatgtatgtctctttaaaaattagttagacaattgagaaggcgcattaagttttgggggttccttggatgttgaaataaatactctttctttcagctgatgaaatttagatggcattggcaggctcaagcccagcttcacagcagagaggagagatttaagatctagggtttgatattccctgccactaggttatgctttaattcctccaggtcctctgaatgatactggatttataagaacactaaataacaccactgggctaaatcccaaagattgaaaaaggcaaacttaagtctgtaactaggatgactatttccttcacatcataaaagatgatacatattctttccaatgcctccccacttctttgaaaatgaaattgacacggatcatgagcaaatggcctacacagactctagacacccctcctccaaaacgcctcttaaagacacagccgttctgtgacagaatcttttacttgaggccaccagtcctctggcagggtaaaatacacccaacagaatacggatggctgatagtgctcccagaatgactgctacccccggattccctattgacatctgccaaacgactgtgcttactctaaacttacgggccttaagaagaccaaaatgttatttcttttagaaccatatttagcagctgttttgtttggtttcagccctaactgacaagcatatgcttacaaaagcaaaacagaacaaagaaaacaggaacagtaggagaactctccacatttatcttgaggcttcaggcttttcaacatcatcttcgaaagtacagcattaggaaactgtgctgactcaacaacccccagattctagtttatgctgcactcacagccaggcaagttccctcaaaggtaattttttactttaacttcccctcttctaaagcagtagaggtttgcagagtcaaaggtcttgctttacacagtaagatttatttaatccctgactgctacctggcaccctccctcgccacctactgtgtgttatacactgtccaaggtagaggcagtggggtacatggcccctgcttcatggtgcttccaatctaaggaaggaagcagacatgagcaacttactacacgtacatagtgattagatcatcataacgacaagcagcatatgagaaaaggtgctccaagagtattgatccaggagatctggaatatagcccagaagcatatcttcattaacctgctggcccaaagaagtcatctcaactggaatagataattcaagtaaaaaacataaatatatacagatagatagatagatgatagatagatagatagatagatagatagatagatagatagatagatgagagagatatggctataggtaggtaaaatactgattgttgatttttcttacttgatcatcagtgtaggacaaattaaactatgcaaacctatcacaggactggtccaaaacaattagggttcaagtctggattccactccttactagagttctttcacccctcatattccagttttcttcatctgtaatttgggaaagtgccctttggcctgcatttttacaatgtcgcatcctgcgtatgaatgttctaggtaactccccagctccctgtgtcaagcatcgtcttttgggaagggctgtcctgagtgtaggctgattccaggacacaaactgctccgatagagctgttcctggctagtgttggtatcctcttactaataccagctcctcaatgatcagctggctactggcagaacacagccaaacctccaggaactaaccctcgatactggtagcttccagtttggctttcatctctcagaacagggagactggagcctcctcacctcctgtttggtttgcagtctgcttagtttcacctgctaatgtgcagcagccagcagtgacactgctttagatcaccctccccgctcagctgcttcactcaagaccctgcagctccagcctgtcctcacaaagtcggcctttagaactggatttgaaacatcactcctcggattaatcactgcaaaaccttaagctatacaataagctataataggcattatcgttgtcattgggataggccatagcctaaatgcttttcatacattttcatatttcttccttatgcaacctgagaaataggtattactaaccccaattttcagatgataaaactaaggcgtcaaggaattaagtaacttgcccaagattaaacagtaagtggtagagacagcagccaagaccagactgtaaagtaaaggtaaaaatacctgtcatggaagatggttctgagaatccaaaacaacatatataaagcatttagcacaatgcatggcagtgcttaataaataatggctacagacatactgctcttgctggtggtattaagagaagtttcccaaggtgatgacaacattggttcatagtagagccaggattcaaatccaggtattttgaatccaagtccattattactcatttctctacaaatggccaatgctgaaattaacctggggttacggggatgctgaaggccttgtgggttaacaatagagccagagaatgggcagtgacctcaggacaggaaaccacaatgagccaaatggctgggagcatagaagttttctataccatggttgcttggtgtccctgcctcttatcagagccagaagccccagagagggagagcaaacaggctctcagatttctatctaaagctagtttctttttttcctactttgccattagctaggatgaatgctaattactttaagctaaccaattaattgacagtgagaggcggtatagcataatagtgaaaaccacagactctacagccaaaagcctgaatcgaatcccagcttcaccattttctagccatatgactttgggcatgttatttaatctttctatgcctgtttcttcaactataaaatactgataatggtagtacccactttgctggattacttgatataataattaatatatataaaatgtgtaaagcaacatctagcatattgtaagtgcttaaaaagtgttcgctaaaaattctttactcaagaaagaataatttctttactccaagaatgaataactcttattggttttgtccactgcagtatctccaatacctcgatcatgactgggacatcagagatattcaataaatattatctggatggagcaagtcctcacatcaccacttcttccaccgacagccacaatgcggtaaggtctgtgacatttgcagcgaggatttctgagatcatatcaataaaatatctctacccattttacagaagagcaaagagaggcccagacaggctctatatacttatgcagttatagatttctccagcaagatagtttaggtgatttatctgaggtcttatcctagttagtggcagagttaaatgaagacctatgtcttttgacttctagtttttccttctgtttgatttcaccctttagtaaaccgatggaatcacccattgcctttcaaaaagtggacctggaaaggaaggaaacagggacagtaggtaggatgggcaggccctgctgttcttttgcaaaatctaggtagttgggttaagaaatcgatttcattcatttccagaaatgatgtaagaagatttagtgcacatggccagtttgacagtccatttagtaggtcacatgcatatatatcagcataaaagataaataatattttcaaaatatatttttctcggttcacagacttagcatattcatactcacagttagctcagttcaaaattatttccttacagatgaaaacaaataattctacataaattgattattgtctactagcttacattgcataaataagtatatacaactaagaatataaaactaaaaagagaacaatccaaggacttcttgtaacactgacttgaatattttttctgattttggtgcatagcacagctattttaatcctttgtcagctgctgggattcactggccagcccttctcatgcttcttgacctgaaattcccaagtcacgactacaaacctgcttgtgcacacaaggaatgcacaagccccaactgtgtgttcagagactgttttctaacacattcagagtcagagaaaggcacaccaactccataaggcaagttaagaaaactcttcagggtactaagccacaagacagatattggagaaggatagctctctccatcacctcctgtaatttttctcagctcttctaaaaaagtcttttaagaagcatacatgcaggccggacacagtggctcacgcctgtaatcccagcactttgggaggctgaggcgggcagatcacgaggtcaggagttcgagaccagcctgaccaacatggtgaaaccccatttctactaaaaatacaaaaattagctgggcgtggtggtacacgcctataatcccagctactcaggaggctgaggcaggagcatcgcttgaaccagggaggtggaggttgcagtgagctgagatcacgccactgcactccagcctgagcgacaaaagcgaaacttggtcaaaacacacacacacacacgcgcacacacacacacacacacacacacacacgcaagttgctttaaaggtcaatatgcacatgaccacccccaaccccagcccctgctcaacctggtcccttccctcccatcatcaggttgttgcagagattatacagctgtttgggaaaatgtatcatacagtttacaaagatttgcaaacatgggatccttccagacctgtcaggacagggtaactttccagtatttccagcaaaacgaggtggaaatgatgggaaccagactagcaaatattttggccttttgcctttttgaagatacttagatgaagaaaaagatagcaactgcaggagatggatttaaagacaagagctggttacctaaataattaagaaagaaagattaggaaacaattcaaggttctgttttggaagaagagccttaacgggaccattcccccagagatactcatttaccacctgcttacaacagaccaatgacacgttatttgcttgaaagaattttcaactgttcttcctacacctataagcaaccatgaagttgattacaggcagaggtgaaacttttaggtaaaagggacctaactctattctaagtctaataggagtatgaggccccctttaccagctgcctacctgtccccacccctcttcacaatacagtgagcttccttctttgccctttgcagagggaacctctgatgagggcaagagttgtgcacactgaaaggggcagggttaatgcctttcggccaagggcccaggacttttctatgagtagggaaatattggctggttgattagatcatctgttactctcccatttccagagaagggtgagatggcccagagccatgtaggaacagccaggagcccaataatagctacctggagcagggacctgtcatctggcagaggtacaaaccaatcttagtccatcacttggtgtcaccagtaatggtacagatggctgaccaataccaactcttataaatctcatacagatgttaataacagggcttcatttgcatctatttttttttcaagcttttatatctatggctaggccaccgtgaaggacatacaaatttatttgcttgcttattagttttgcaaggcagataacattttggaacgggggatttataccatctgttcaaggatctaaaagctttttggcagactcaagaagctaaagccagtccttttgtccctccagatttccatgggtgttgaatttccactgtcaaataagtttgggaacactaggttaaaaagattagcaggttaggggtttctttactgcaaggcctctcaaagcttttaatgtgttaatgtaccctgtgaatctccaagacagggcaaagcttttcatattttcctaacttgtctggccacagaacactccttaaggaagctttgtatctcctctaagcactgatattctgcagagcatagaatggaaaatgacagtgtatagagcaatcttttctgtgtcattcctacttaactaaagcttgcatcttaagttactgtaacagagatggatcaatgccacccaatattcattctccccttgctccttaacaaaaattccaattttatttgggaggaaatgcacccagctcaaaatctacatgcccttgtcccactgaagctaggaatgaatacatgactaaattctggccaatggtatgtaagcagaattactgtgtggggcattcagaagggctgcccaaatggagctgacttagctgggagaagggttcttctgtcttcctccctcctccttcctgctgcctggaatgcagatgtaatggctagaacactacagccatttctgatcctgaggtgaatttaagaatggaagccttatgctaagattgttatagcggaacaataaaatgatcctatggttctgacgatcatggagctaccatgctaccgctaagctgcctatgtctgaacttctttatcttgaaagagaaacaaacttctatcttccttaacccactaatattttgagttttctgtttgaagcagctgaaatctaattgatttactttgaagtttactgttcagatatttttattcatttatgtttaactaacattccttctttaaaggactcttctccattagccttttgctctttggtagaggtggcagtctctaaggttgttgaatacatcttttttttttttttttttttttgagacagtctcgctctgtcagccaggctggagggcagtggcatgatctcagctcactgcaacctccgtctcccgggctcaagcaattcttctgcctcagcctctgaagtagttaagattacaggcgtatgccaccatgctcagctaatttttgtatttttaggagagacagggtttcaccatgttggccaggctggtctcaaactcctgacctcaggtaatcccctcgcctcagcctcccaaagtgctgggattataggcatgagccaccgtgcccggcctgaataaatgttctatttctcctcctgctggcatgttataggatggcacttccctacccctcttgaagctggctggggccacatgatttactttggctaataaagtgtgcatggaagtgatgttccacttccagatggaatatgtgactgacagttcaaatcattgtgatgactgtggaagcatatgtggacatgatgcctccattagtctggtacttggatagctgatgaatggagtcctctactgacccactctaggcatgtggcatggtcgagaaataaactttagttatataaagcctctaagagtgttcattaccatatcctatcctactctactctgactgaaagaatagaaaagaccagaaactgatgataataataatcatattgtataatgctttgtaacttttgaaacaatatttgagaagaactgcttcacactgaatgtctccccatgccccagacattatgcagggtattttgcaaaggttattttatttcatctctgcatcaatcctgtgaagtagattgctcacaagagaaaaaaagcgaggctacaagagcctccaatgccaaaacatacattctcctcactgtctcccatgtgcaatatctgaaggcagctcccagaaacagtaaaatcccttccaaagctggctgatgatacagggggcaaggaaagaccagaatttttacaaggtgcctacgttcacaaggctgactacacctacatggcctaaaccagagcatgctggagcttgtggtctctgcaccccactgagggcaacagaattgcaagtcctcgactgctcttttttgagtgtctttgaactcaaaacctgctttttgagccactgtcaaggtaacctagcagctgagaataactaattgggcaacgttctctgactgctggcatgaacagttataatctcagcatcactgtggcaacctgactggaatgctggttattcacacaaagaaaaactggtctccattcagaccagaattgcattttgtctttgttccacttttcccattacaagttgctactgaaggaacaatgcttcttttaagaagaatgtgtattattggtctgtgcaaaagcagcattttcttagccaaaaaaaaatttggaaagggaggaaaaagtaatatgtcctatattgccaaaggcaaagagactattaagaaagctctatataaacaacagtaaaggtcatcttggggtaattctgtggcgtttcagccaggccacagaattctgtggagatctcaatggtgcaacatgggcaacagatgactaaaaactagattacattcaatcaaccagtgcacatttcctgagcacctacaatgtgctatcacagacactgtcctccaaatctcccagtggttccccggtctactctgctctcccatccaacctcagcctccctttaaagctacagcacacctctccccaggcatcagctacagcctccagctcaccattcccagaagatgttctgtacactcccgcattctgtgtccttgttccctttttgttcttgctatccaaaaagtccttttgtcccatctttgtcagtcaaagccttaccagtcttttgagatcagattcaaatcatagttcctacctaaggtcctcccattacactccattagagtaaattccacattaaagtacattccaaagatcgctttgaatgtatctgtcttactgcacttggaaggcaactctccagggagcaagatcagcatttgaataaggctttaccacttccagttgtgttatctttgaaaaatcacttaatctcttagagccaaagtctcttcacctataaacagcatgctactcagactgcacccatgaccatccaactcatctgggaaccttgttacaaatgcagaaatctgggccctgcccagacctactgcatcaggattaacattttaataagattcccaagttatcccaatgcatattaatggtaccaaagtattgataaaatctacccagcagagatatgatgagaatgaggggaaacatagaaaacatccaacggggagtctaatacataaagactctcactaaatgaggaaatgactacactttatatccaataaatgtttggttaagttgaactgtttggtgttttaaaggattcagatatttatggcatgagctggccctcaagtgacatgtcagattagtaaaaatagattaaaatacatgaaatataaatgaagagaagcaaaagaactgtgttttagaagagcacatgactgaaaatgacttcatcgtttataatttttctgacattgaacaaggccactaatattttttagcctttggtgtcttttcctatcaagtagaaataagaataaaggcagcctgcttgcctctcagagttgaactaaagttattctaaagttaaaatgagctaaagagaatgaaggaattttgccaaatacaaagaaatgattaagtcggtgtttatcaagtaacactaaaatacaacatacccatcacaaactgagctcacactcaaaggtggccaaacatgaagggcacacggaggtcaaaacggtacattaaggccactggtttgaggatggagttttagtggaaagaatgaagagtgagccaaaggggacaagtagctctgccttctcagtgggctgatgactgaggtatctactgctttgaaaatactgggataggagtgggaggggacaccagctgggccctagaagaaaaggaattcacagcaaacctggggccctctcagcctaggggttaagagagaaatcagaagggagtctcacgactgtcagggcagaggcctgagactagacggaggtgtgtggcagccactctgacgaggaacacagaggaaacatttgctggaggaacctccatcatccatttctcaagaaccctgctcaagaaaggagaaaggatggagtttgggatctctgctctaacaagtcagacaagcagaacataacataaatgcaaagagagttcagacaggcaggaaatcgatacaaactgacacagtcaagcggagctgaatggaaaaggtgggcaccaagctagactttaaaatacctgcaggatttgggtacacagacagagatatcagtagaggggataaacttgctttgttaatagtattattttaaaagaacacatgttaattgcatgtatcatttctgtcagaaatgataaaacaatcctatcacttataggacagcatatgcattcagcaaactttaaattatttctagaaatcaggattccgtaagcatttcataaggcaaatggatttcaagtattgaacacacatggctatgacaaaatggcagacatgcatgcgataaagaatataagccagtcatttttttgaacaaaatgctgtttgaggcctcacttctcccaggcaaatgaacaaatacataaatgactctgatgtaataacttgtttacatccgtattccccactcagctatgctcctgctccttccaaagctgaagctgggctccattcatgttaatatctttagctacatgcactgtacctaggctacagggggaccttcataaatgctggttaagtaaataattttaccaagatcaacaacaagaaaatatttataagttgttgtttactttttcttgtgaaataaataaataactcggagagagatgaatacatgtatcttcacatcattaaatataccttcctctgagagtaccagctgggtcccagagaatctgtgaagctgcattcaaccacggcatatctttttggaaagcctattttccataaaaactttggtgttcgtggtgttttttaatatgttaaattaaacatgaataagtttgtatcaagtttaaaaataaaacacaaagatgctaacaaatttctggtttgcagtggaggtttctcagtcagtccaccagaatctctagggtttccagtttcctcttctttacccacagggatgttttgataaagacattcagaagtgtattgctcacctataccatttatagccctaattttcaaacacaataaatgcttcttatttcacctctactcattcagaatttgcaattactgaaattagagctgaacagaagtttaattgtctattgtccatatagaatagatttcaagaaaagtaataacataaaaaaggaaatctcatttttaaaaatcttcagtcaagtatcattcacatccagtcacttgctaattacaattagacatctctatcaaagccagtgttctctgctaaaggtggtgttccaggacctctgttgaaaaactttgccactccagggtttctcagttattgtctaaacctaaaagggaataagattcttcaaaaattattattgtcttacctttcagcaatataaaatgtccctgctcctcccaggtctctggattagggaggtttttctgtgaggcaaataatagagcaattctattccttaaatagagagatggtcacactggtgctaattaaataagctgagcatgtttgctttgtgcacttttcagtacatattttacaatttaaaagtttgaaaaaataatttaatcattaagagggcagcttcaatttagaagaatgaggaaacagacataagcaacccaacaattaaactatcagttccctgttctaggagtggttcaaagttcagaaatgaaggcctacttgagaggcagtagaggtaagtgtcttttattagtgcagaaattctcactcttaattactgaattccactcagtcattaaccatactatagtgcaatgctaactacataatgctagtagatagagtgtctcctacattgagataccagtgtttgccagtgtgtgtaactaaagcaagcctacagccacatctccaaaacctgacatcggctcttacatcttccacattttgtttcaaatctttctagggatagttctttcaaaatccctctcatgtgcccttctcagtcactatactcaaatgcttttatgagataagaaacttaaggagtatgtgtctggggatatttttaggaagagatggattttgtgcagctgattattaagtcaaataatgaattaagaataatgacaacaattgaagtgaaaaatctgcgtcattacagtaatctttctctcttgaacagaactatttggcttaaatcaaagccacctgtaggattatgaatttcaaaccactaggagtgaggcatatgaagtttctaattagcactggccaggaaacattagttctcccctttgcggtatcttacaggtggggatagagtgattgtatgttctcaggagaaatttgcagttaaaatggcctagtggttcagaacttggactccaacagaactgaaataatgactgtactatcagaaaaatataggtgagcaaggagtgtggggggaggggacgggggggagcagatctttccaaagaaagattgctgccagtgaactaattgactatttaatgtgtttattttacttgaccatctccaggagtgatacaaaataattaaacagcctgtatgtattttggtgatttccatatatcctaaagtactcaatacaaagactggcctgggccagagctggcatgactgccctcagcttccagttctagtgccatcttatccctcctaatcaatttcctctgggcagagatgtccaacaaccaccacagaaaggcctggcttagaatcttatttttataaaacataacaacttcccattgacacacattattgaatagagatactcttctgaaaaggttaggggtctctaagaagtaatacaaagaacactttaaaatgtagtaacttacatatttttaaaattaggtataaaaagatgcaaagagcactggtcattgtagaaatcatttcagtttaaaattcaggtcctgccacgcattagctatgtgactgagcaatctatgttactttgttgagtttcctagtgtcttggggatgaactgtgtctcccacaaagggtgacttcttccctactgcttcagcactcacataggcatccttacacacacacactacctttgtgttctacttcaactgctttcagttagtctgttcacaaacaacttccttaaaaactgatttccatcttcaaatcagagtaagcatcgtgtacacaaagcccttcctaaatcccatttcctcctccccagcagagcttagttgcttctcctttgtgttctaacagtatttgactatagcacttgccatgtattgtaactatgtgtttaagtgcctaactccacctctagactgcaagctacttgaagtacatacagtttttgaatgttattggtatctctagttttttaacagtatcaaaactgacagtaagttctcagtgttacacaaaggagttgattaatagcagtgttcatttcttgtatacttactatgtgctaagcacttacatgcattttctgtaatcctgacatgaactctctaaggtggacattagtattttaattttatagaagagaaacctgaggccccaaaacaacaaataagtgattaaagtcaggatttgcccaatctccaatctgttcacaagggatctagcacaaccacctggtacttattaggtcctcaaaaatgccatcttttttcctactgcccagaaaacaatgggaatgtgacttctgcaatggaagtaccagaaactgtgtccgttggtgctggctaacactattacttagaaaattttgatacaaaaagctcatttcaccaagtctgtgtcagcaaccataaacagatttttcaattgcacattaataattcccaaaaatattttccgagtgcctgctctgtgccagttctgtactgtacactaaagatctatgaataaaaagtcaagaccccagtctcaagaagcagacaccacgaggtaccaacatttgtagagcacttgctatggaaactttagagcacctgggaggacataatcttaatggacagatgttacatgcccattaaacccatcattaggggatctatgaatcatttaacggaacatagagtagcctgttctgtgccatgtatgtggccacaggagattcttttaggaagataatgtcctccatttgccaatgtttgtgttaaaattgaagtgcagccagcccacaggggtactcctaccagcatgtacttaggggattgatcagggtttccaatgaaatggcaatatggcagccacatagtgaagcagagagcatcaagacataaaagccgttcattattgaaactttacaacaaattccctgacaacctttccctggagaagccccttgtttctgccaacccattacatctattttgaggctggcaacctgatgtgcctctgcacacaaccccaagaggcacccttcatatacaatacaacatgatgcaaatacatcttgattggttcctctggagctgtgtgacaaggtggtcctgactaccaaagtaattaaggttctcatgcaccttcagttgccaagccattatcaacacatttgattttcagggaacatgtgaggagacctctgagcctttgtggcacgaatttaccaaaggggagcaaagcctagtgagtgaggtgcctctttctgcccaaaagtgcaagtgcatgatcagccatatggaagagatcccgggtaattactctcggtactttcgtttagctattaaaatgccacccaactgtcaaaccttcactcagtgttaattactgccacaccgtgtttgaatgcagcacaagtaggactgaaagtagaaaataaataataactatgcaaggttacagcctctttttgtacctctggttgcagtaaccaccttcgatctctttttaaggcctttcgttctcaccgtcattccctcatggactgagcagttgtttacaaattgcaaatgcctatgaaaagcccctatttcacagggtctcgcacacagccactcaattaatggaactaaatgccttggttaggttcacagaagctgctgaataactgccatgctgcacttggcatttgcctccagaggaagaacatgatgctgggtgatgttggtgatctcacctcttggtacattagctttcagctgaaagttcaaggccatcaagctgcttctctgactggcagagagggtgcatattaacctcacacctatccttcatgagataactgtgctggcttattctgctcttggactggagctatattttatccagcagttcttaacctgtgcccatggatgttgtgaacctgctaaaactagatactatgctttgtgcatgtgtgatttataggaaagggagcccaaacactgatcatctgaaaggactctaatatctagaatcttaggtgacctttcaacggtccttcaacacaagctgggcaagtgtatattcacctccatttcataacagaataaacaaatgctgagctgtgacttgcctgagtgatctgagaataagttgaggcacttttccagtactaattaacatcttcccagaggatgcatctaccatttgtaatatgtgagatgcatttatctcacataaatcaccttcgctgggatgatttgtctttcatctagactgtaagcccaaaagacaaaaactatttttgtctgtcttatcatctccatgtgtgtgtgtaatagaggaacagtgtttgtaccgaaggggatcaatgtttgtcagtctaaaacatgccatgatggcataagaattattttgagctaaaggcaactgacaaacatcagatgtatataaagctgtctactccccttgtatctgcctaaagtcagggcataaattttcctcagtgaagatgttctctctttcctctcccataccaggaagaggaggcaactcttattgctgaagatggcactgacttcaatctgcataaacaaaattgactgtaataaatcttatctttcattagttttccccatatacttatcttcacataaataagtacccctagaagtccaaaacccctttcttttctcttgtcatattgccacaatttattgttctttgttaagatggtatatataagcccccaattctaaccacttccttaagttatatttctttgtgaacttccatgcatatgtatgtaattaaatctgttcttttctcttgttaatctgtcttttttcagttaacttgtaggcccccagtactgaatctaaaatagtggatgaaaaagtcttaccctttcctatagtatataacaataactgtgatcagtgaacagatgcaaaccaaccttcagtttccaaaaatatttatttctgttttctgtcacaagacacctgtaggacaattttttttgatgaccataagatgtaaaggacaatgcttagaaaaacctagacaccaagaaaaacctgctaatgtctgcaagaaaagaacttcataatccagaagttcccaaaactctataattgctgaagaataactagaattttaacaaattgctcaaaatctcctttcaagtcctcacaaaatcagctaattcattaaaaagaaattacattatatgccccattacatttcataggacactggagatggacacaggcactcaggaaatactgggaaatagggacagtgatacaaatgacaataagataaaacaataaggatccagagaatggcatttgaaacttgaaaactgtatattgaaaagggtgattccagaaatttaatctggtcacaatgtctaaactggtggctatgagaaaggggaggagagggatggagtcagcaagaccagataaaggcagaatgacataattaatgtgtagcactttcagcatatgaaaacagcacttccttcatcttcccaaagaccatcagcgttgatcatattttattattaagaaaatacaggctgggcacagtggctcggcctgaagtcccagcactttgggaggccaaagtgggtggatcacttgaggtcaggagttcgtgaccagcctggccaacatggcaaaaccctgactcaactaaaaatacaataatcagcagggtgtggtgggggatgcctgtaatcccagctactcaggaggctgagcaggagaatcacttgaacccagaaggtggaggctgcagtgagccgagatcgtgccattgcactccagcctgggtgacagaacgagattctgtctcaaaaaaaaaaaaaaaaagaaaagaaagaaagaaaatacagttatcatactgtattcagtgtattcaatgcatactttgtctcatcagtgaggaaattttcaactattttctgggcaaaaagagtaataatccttggtagtaataaccatttatctgaaagaaagcacttccacaagctttctgtcacattttaaaataaaaaaaaaatgagccttctccctttacaatgcaggcatttctaggaaccactgtaaaagggcccactttttcagtatgtctaagagcagacagcactttccaccacctgccttgcccactctctcctagctcagtgcactttctcaggttgcacaagtacgaacacatggagaatgcaaagaatctatctaagtttggcagtgcttgctgcattctgcctgtagaagtgcccccaaatggtgcaagctgaagcaaaacagccgcagaagcaaaatacaatctcgcggtcagtgcagacccagctgcccttgtctcttagacattcctggctggaatcccactgagcaaatatagggggaaaacagacaagaaaggccctagattcaggaaatacccagctgctgcaggagagagcagcttacaaacagcaatttccctttaaaagtgcccccaagggcagatctctaaattatccctcgatatttcttttcaatcatgccatgaccctaccactggtttttaaactcctcctcttgaaccatatgatggacctacaagcagccagtaggttctcaaacacagctttcactattaggcctgaaatccaaagggaataacgttaccctctcatagcatagtttcctcattcagccatttctcaaaccttttttctccaaaattcttgctatcaagagtgactgttaataccaacagaaggacaagccttcaaggaacacagtaactgatctctttcgtaattttcatttgtcaaactaagggaagctatacaacttagaaatcaaatgtcatgttcatttatcaggtatttattctattccaaatctacacaggacacggacagaaaagattcatgcattcttttgaccgatatttattaagtacttactgcaattcatcaagtctaaaatacatattttttcacattttgacatttctggaattgggatgcatctgaaaattaagattctggttttcttcttttagtatataaaataatatagcatcttacaatcaattgcacatgccatggacgaaatgcttaaaacttctcaaatgagtacagccatcttttcccttgaacttgtcctcctctttcaaatgcatcctcagaggctggtaccagagtaatttttatctggggcaaatcttgtcctgtgacccttccccctgtttgaaccagccaatgaattccctttacctatgggtaagcatggagtcagaggtccttcatgacatgtcccagaccaacactggcagctcatctccccttgtctcctgccaaattataaattttcctcaatataccaatttctctgaactcaatataacttttagaattctgctcaagtattgactacctgaaaactttctctgacacttctatccccaaggttgaagtaaatgtcaatcttttgaggtcccacagcctcctatgctttattatattattaccacactctaatttggggctcttgatctatgtcccccaaaagaccaagatctccacaaagggaaaggttgtgccttgcacatttctgatgaaaaaccccagggacactgcctggcatggagttgaagatcaaaacataattgaaaggatggatgaacaaaccttatgacatctcatcctcagttcataagacacctagcttttagagatcatcagcaaccaaacaggatttcaattcttgttactcttgggttttgtctaaaaaacaaatgggaattcaagaaaaattgtttcttagtttctttccattctataattttgttatttgtgctccactgaaaattacctgctattctatccatctggcattgatcaaatactgcctttgcctatgaagcacctttttaaaaatggattctcagattggcaaaacagtctcgcacctaagattcttgagctgtgtgtgtgttgcagggggaggagagaacatgtctaaaactccggggaaatacgtcatttgagagcacatatttggtttaattttatacctagaaaacaaatgctctctgcattataaactaaacaatatacggcttgataaggtgatcttggctgatggagaaagaaaaaacgattgagattctcaactggggaaaagacatgatatttttatgaagtttatcaaagggagatatgagttttagaagttcaggaaaaactggcacagtaaaagctaatatggcataatcgttaacagcagattctggcagtagacagacacggggtgaaattccggatctatccctcgctaactggctctttgattctgaacaatttacttaatctctccaagccttccttttgtcatcagtaaaacagggattatcaggcacacctcatagggtcattataggactcaaatcaaagattgcatataaagctcctctaaccgtgcttggcacttaacaggcccctcaaaaatggtcgcaattattacaactattaataacatctcttctccagttaaatacagagcctacattatatgtcccattacattgcataggacactggaaatggacacaggcactcaagaagtactaggaaataggcatggtgatgacaaatgacaataagataaaacagtaagtatccatagaaagacatttgatatttgaaaactgtatattgaaaagatatcttttctacgattaaccaggttttttagattacagttatttttaacttatgaaatacagataccatgagcatttgtgacatatgcgtgcagttcaaataataataaattgaacggagtgaacatccgtgtacccaccaccctgcttaggaaacttaggaaacagaacgttaccacttggaaatcatctgactgtctttccctgatgtaccctcctctcatagcccagggtaatgtcttgaattttatgtttctcgtgtttttcactccttgctttttaaaaaacaggtttattaagatataattcataaaccatacaatcatccaatcaaagtttacaagtcaatggtttttagtgtattctcagatatgtgcaaccatcaccaccataaattttaggacatttcatcgcctcaaaaagaaaccccataccctgtagctaccactcctcagacccctcatcctcccacccactgcccccccaaccctaagcaatcagtcatctactttctctacggagttctctgtcctggacattccataagaatgaaatcatacaatatgtgaccttttgtgactggcctctttcacttagcataatgttttgtaagttcattcacatagtagcatatatcattacttcattcctttttatggccaagcaacatgccattgtttggagacaccaaactttattcctccattcatcagttgatggacattgtattgtttctgtctttaggctattacaaataacgctgctatgaacatttgtgcacaactttttgtatagacatattttcatttcagttgggtacacaatacgtaggagtagaattgcctggttatatggcaattgtttaaccttttgagaagctgaactcaccagcttttatactgatctccaggtggcagaaagctaaaagtatgtcagtgacttatggtgctaaaccaacctattcagccaacagcaggccctcaatgccagtgaaaactcttcataagtagttacacatcaattattcataggtgtgcaaatcctatcttctaagaattgaaattttctagcagttaaagaaagccagtagcaagaagagaagacttagtagaaacaaggctcttccacttcctagccattctcagttgattcttttgactctcagactaccatttttaaggtatttttcatgttgattcagtctactgtgtctgtgttgacaacttcaatgatgaaaccactaaagatggaatataaaaatggactcatattgaagacctacagaaatatcaatgcattaggtacagacaattttttcagaccaatgacttccagcaagtatgtttataaaaattaaatctacttctcaccaagagtctgaattgccagaaatacactggcatgaagagaaagcaggcaaggggtagaaggaaagagattaaggagcagaagcttcatctgaaagcctctgaaatgtggcatctggaaaatctattcacaccctcacaaatcacttttggtctgatgtgccagtctctaaagcctttgatacaagagtgcgaagggcatctgtctctgattttcctactcaacacttgtcttgttttctacagtctgctacactccccttttgttagccacagacagattgatggacagagtgaggtgacggaccaaggagtacattattcacctttacattagctatgttggggggttaaaaagttggccaacacagtaacgcctctgaattttaacacagtatttctgaatgtctttgactcaagtaaactattgctcagagagatgtagactaggaggacctaggaagcagaaattctcagtatcctatcgtgactggaatgaaaacatgctgactgcccagctacccatgtgaactccacattcccctcatcttgaagtgaaattagttaagaacagagagaaaataaaacacctctttgtattgacaatcgaacttacaaaatgacaacttaccaaaaaaatttacatttgaaatatagagatatcactgtaatatgtttatatcttaaagaaaatgcatacacatatacagaggcttgtatattataatttcctaaaacccaaacacattcaggcaatccaaatacattagatattagtatgtagagtttatcaatgaaactatttctataatacaacatacacgctttttttcttttatgcttatttctgtggtctagatttacaacacttaccaaaataaacaaactaaaaccaaataataaaagaaactgctgtctaatatcccttggggaatctcaacatttttatcttattcttaaccacactgctggagaattcttagaccttagatatgaagtgatatttaatgaataagaaatgctggagaaagaaaatacaacaggctggtgatatgcatacttttaatttatgttggccaaaacacaattttcccatttactgattcttttcacaccagtcacagtaaatagcacagacttttgtagataccaaaataactgatgttttactattagcacttttcaaatcattcctccttagactgtcacctttttccagctcaaaacagacttcacaactgcaagtttccactgtgtagttccaacattgcaatattttccccaaagaggtgtgaaacaggtcagtatacagagctaatagcatcacatttttatttagggggaaaaatacatgttacgaaattgttgggatagcgtaaaagaacaccagcttctgtgtttttaagcaacttgggaatccatatcttctatttagtacctgcacagtagtgtttcacagagagattggctatctctaaacagctgacaaaggaatccaaactcctcttggtatggcccacacagcccttcacaatttgtacccagtccaactttccagctcagctcccattgtccttctactatgtaccaaatcagtgttacctaaactttttcataaggcacactgaggtaaatgaacaactgggctcaagccccaggaatgaaaggataactgtctatgcagccccatcacctggtatgtcactgaggtaggggcattctacctacattctacctatgggagtgtattcatggttcctttgacgtgtcatgtaaccatcgcaagtctgcagttttgcacacactattccctttccctggaacatttttcccctccgtacgaaagaaataattcttatttttcaagactcagctcagacttcacctctgcagcacaggtgttcttgccctctgctgcctccttagccccaagaatcagaggctctcctctctgtgctcccaggggacttctcacccacagtaggtcacttctctgtcttctacactgcaagtgagccccttgagagcttacttacttttctaacttcagaggtaagcacaatgtctgacaaattgtaggtgctccattgctgttctttgaaataattcagaatttctccaaagcatgcagagaatagagaaaattcaaaaccagtctctatcaaatagggaattattctgaagcatatgtgctcaatttcacctgtggcaggacttgccatttatggattcctggagaaatgctttgatgcctccttctgaaattcaacatgcagtctaaaagagctcaagtagatgcaaacaggagcaggcaaattcccttggaccctgagcctccctccctcccagaggcaggtttagctggaggccaaacaatcacaagagtgctggtcccacccagaaatccaacaatattcagcatctaaaaacatgtcctaaagaaatcaccagcaatgcacaagcaattctgctcaaggttattaaatgtagcattatttataagagtacaaataggaaacagcctaaatgttaaacaacagagacctagttaaataaattatgactatctcaatgctagagaatagtaggcaaccgataaaaaaattatgttgataagaattttttatggcaataaatattattaccaaaaaacaaaaaaggaataaacaacactatatacagtttgatccaaattttacttataaaaacatatatatgtgtgcttgcaaaagtaagaagactggaagaaaatatacgtgtttagtggcatgtatatctgagtgacattatagtgataaaaaatttattttattctccattctctttcagtattttccaagttttctgtagcaagtatgctttacttttgtatggaaaaatcaggaggtggggaagtaataaaaatcaaagcagaaaggagtaaaaagttattattgccgagctgttctactctgggctgcatacagctgtccaccaatgttctgggaagctggcccattgtcaggatcacaggacacagcaggagtaaggctctcacaggaatatacaccctgggtgccccagatctgccctagactcagagtggacccgggacctgatgggttttcttaaattggtagaaaccatactctgggcccacagttcccttgccatctaggacaaaaatctaagacctaaatctagttttctgaatttgatttgcaagagtttcaagaaatcatgccaaatttcccctggtgttctcattttcctcatagaaaatgctagattcaggccaggcacggtaggtcacacctgtaatcccaacactttgggaggccaaggcgagaggattgcttaagcccaggagtttgagaccagccgaggcagcatagtgagacctcatctctacaaaaaattttacaaaaaattggctgagcatggtagtgcattcctgtagtcccagatacttgggaggctaagattgaaggatcatttgggcccaggaggtcaaggctgcagtgagccatattgcaccactgcactccagcctgggcaacagagtgagaccctcctatctcacaataaataaataaataaataaataaagtgctagatccagaccccagccagaaagacatttcctccccaagaatattcttccacatcctcctttttgtaaatacagttccatattattcttaatgttgctgaaaaatattttttggaaacacttaacacatgaaagaaattaagcaggacaactaggagtggatggtgtcacaaagacaaggaaagagtctcctaagcaccatatgcccccaaagataccaagatgagacagatcccaaaagcgtccttcggatttggcttctactggtgctgatgatctctaccagattcagggaggactgaagtcagaataacaaagtggtgtgtatacctgagtgatgttataatctttctttaaggggtttgcctgggaatagcaggagaatcaggccagtgctcacagggttgagacaaacacatatctagttggaagctagtgaagaatacagggaaaagggggtcaatgaaaactgaggagagacaggaataatgagagcagatctagtcctgaagaaaacaaaaaaagaagaagctgggaaccagagctccatatttccttctctcctgaattttcatttaggagaggtgagggatcacccttgaatgaaagaggtactttgtcttctggaacctgacccagtgattcttaaccagggagcccatcagaatctcctgtggcaattttacagccaacacaggcttgggctcctcctcctcctcacctcaccagcagacctactgaacggtcctcttcaggacgaggactaggctgagttatttctaaaagctcccaggtaattaagatgcacaatgctgtctaacgatcactggttagaaaggaggaaagggtgatgatggtaggaaatagcttcataggtgtaagagcaggaaactgaggaaggagagggttcagggttctctcaactaggaggtaaggtcaagaagtagagggcttagggagcagtgaagtcttaaaatagtctctgtgcactgctcagaacaaggcatgtgggggcaggaggaggggcaacactttatcaaatgtctaggagcatcaaggtacatcgtggagtgatttttcccaggagggttcagaaatgtagaaagcaagtgagaagcagatggtcagattaatctatatgtgggagtttcagggggatttggcatgaaagagcaaggaagtaatttaatatcaacctcatagggctgttggaagaattaaataatgcatttaaacacagtccagtgcctgacacaaaatgagagctcaataaatgttagctgttattgtcattgctacaaccactgttgttatttatttctggaaccaagcaaagtgatcacgtctgtttcttaggaatctatcaaatagaagtcagcagttgcttctcaattaacagaggaaaaattcgaaagctatgtggggtgttaaacccctcaaacaagaaatgctaataatcatatatttctgtaggcttccattaacttagttttgaatagctagttgttgagcattcttgcaataatgactaacgataactggtaccacttttactataaatacagcagcacaaaagacttaagaaattgaatggaaaataatgctctctttagaaagcccatgtgaggctgtttaaggtaagacattctgaacctttattccattactgctgcctccatccattcaaaaaggatttgtggaagttggcaaagatgcatacaaaacaaaattaagaaaagaaagtaaggcaaccagtctaaagagaagtaaagggtaaggaaaaatgtattcggtgtccaatgcacaggcaaagaggtccctttcacaatgctagttgtgggtctcgaatttggctgtgaaccacctggcagtggactaaagagggaaacaggaacagtactcacagtttccaaaaccaagggaaatactgctattattgttaataaagtgtgaaaattttttccttcatagattgaccgtgatatagtgaacaatgtctataatatccttacatcaaggtttaatcacctgactaaaagatacccttcctccagcttcaaaaaaacatccttaacttctggtagaagagacatggtaccagaatcaaaggttagctctccaaaatttaggaattttttctatgttatttattagtccttatgttccatcaaagacagaatcattttgaagcatatccagctcaaataaattaatgttcccattttttggaggaaataagtttacatacttaaatatgacctgcataatcactcatctaacagtaaagtatatttttcaacccagaattattttgcccagccaaagtatttttaaaaattgtaggaacaccataaagacatgctcagatatgcactgtctaaaagttttccttcctttctctgaaagctactgaaaaatgtgctccatgaaaataagggagtaaacaaagaaagaggatccaggaaatgggagctagcacaaaaagggaaaaggatgacggtgaaaggaaatcccagtatggcaggcctagggcacagatagtccagcctggggctggtcagaggctccagaagaaatggccccaacaagatgaaacagatgaatagctgctgtggctaaatacgttaaagagaacagcccacacctggggaagagtgtagaactacactagtgatgagtacgctgaaaaccaagcaaacaagagcttttgtcttagaaaagggggtgaatggccgggcacggtggctcacgcctgtaatcccagcactttgggagacgaaggcaggcagattacctgagatcagaagttcgagatcagcctggctaacatggtgaaaccccgtctctactaaatatacaaaattagttgggcgtggtggcacacgcctgtaatcccagctactccagaggctgaggcaggagaatctcttaaacccgggaagcagaggttgcagtgagccgggatcgtgccactgcactccaacctgggcgacagtgagactccgtatcaaaaaaaaaaaaaaaaaaaaaagaaaagaaaagggggtgaatagaaatagatccatttgcttgcacaaggaaacaatggaagcataagaaactaataaagacagcaacttacaggagatggagaataatggagacagtagaactagaatagagtgaggttttttaaagtacactttctatgttgttttaatttctaaaccatgtgaaagtactacctgttcaaaatcaaataaaaataaagttctaagattgttttctgctaacagtgtccagaggctttacttgttcttttgacagcatcaactgctgacccacacttggctttctgtattgcacacatctatagagaattagaggcaaagaggtcacaggatatggctacagccttgaaaataaaatcagtgaagataagagaagtgggagaagcatcttcaatttatcaaagcatgaagtacagccacttgttttctagaaaaaatagtactggctatgtacctacagtataacccatataagtgtatagaaatcagatgtattaacaagttgtttttaatgggggctctatgagaattttgaccatgcagttcttcctcaaattcccctgtgcgttttgaggagtaaggatccctagccactgtccaccaaatgtcagtgtgactcctcagtcactgaggcaataaaaaatgttccctcctccacatttccagaagctcatactcccaactgagaaccactgtgaggaataagtaaaaaaattaaaaattaacatttgtcaatttttttccctatcactgccactaatttttatcagttcattaatttaatgaatctttataacacattcattaagaaatcatgaacaatctgatcttccaaatgcttgggtgttactaaagatagtttgtgccttgagtttgtttttttttttaaccgagctagagaaaatctgaggaatctagaatccctgccagccttcagtcaaagtcctgcttcacaactgcagagtatgcagtttaattttttttaagttcttatatattctctcattgacaaaggctaattacttctcttaagagtcatgtaagctcagcaaggaaaatactattttccccattttcacagatagggagtctaaaggtcagagcagtgaagtgatttttccaagctcataattgacagaacttggagcagaaaccagaacttctggttgtcagtctggcggtttctccactcagctgtgatgtttactctagacagtattttctctatgccaagcctataacacatcagcttgattcaaatctttaacacgatgattataaatttgaaacccagcatcttatttttaaactgacaggtcaactataatggtcctcaaaatggtacactttgaaaatcaataaaggtgactgagggttttacacaggttagcttgtgtggtcttcccaatagttcttctaggtagatacaatcattatccattttacagatgaggaaatgtaggcagagaaaggggtaagcaatgtgttacttaaggccacacactagtaagtaacagtgtggatttgaacgcaagcagtcaaactcaagtcggggaaaactcccagtagatttaactaagaaataaaccccccagaaaaactggcaggtggattgtttagataaacaatgaaatgtctctttagctctgtaaagaaaaccagcaacccctatgtaagtttttgatcaactggtaaaaatgacctcaaaatatagaaacaagcaagtaactgtccctctatcaaactaaataatattttaattgcctaagtagtgggcatttaataaatcatcaattttctattctattaataatatttctgtggaaacaagacaactctcaatcaccaaatctggtaaaaaaaaaaaaatcacaacaaaaatcatacagaggcaacacaccgagttaaacaacagcctggagaaaatagattcattttattcaacttcaaaagtgataagaagttgactccaattattctattccacataggaggttatgatgcttatgaccaatagccaatgcataagactgataattttctagtctaaaatttctacagagcatcccaaaattctattttcaaccaagtttaatctccagaagtaagagtatgatatcttggtaagaaacactatttaatataaaaattcatagtcatgaaataatttagtaagacaccaaaagggtcacagtcttacctcaaaaaccatgtgcatactgaaaagtagccaggttgagggcaagtaagaacttagggaaaagcctgaactatcaaagaaatcatctgtctaagtccccagaagaatcaacctctacagaggtaaaaatggaaagggcgggaggagatacagctataagtaaaactccatgtggcctatattctatgataatgtatgatcaatggtacaatataggtaggtaagcatatatggatctataacaccagaaaaacaaacacatgttgagttaataattagatatctaatgatcaaagaagagctagaagtgaaaaaaaaaaccagagcacctacttaccatgggttcagtggtggtccctgttgccagcacacattccgtaatctcggaatcctgtggctagtccactctactgcctccctagatgatggaactctgatgccatggcacattgcaggagctacctagtcatatcaacagagttacagactcaggaattgagaagaacccagagctcggaggccatgcagcagggcaccctccatattgagagcaaacaccatttggggtttggggtttatttatttatttttttttaagacagggcctcacactgtcacccagactggagtacagtggcacaattatagcttactgtaaccgtgagctcccaggctcaagccatcctcctgcctcagcctcctgagtagccaggactacaggcatgcactaccacaccagttattattatctcttatttttctggtagagacaggatctcactgttgcccaggctggacgtgaagtcctggcctcaggtgatcttcccacctgggcctcccaagttgctgggattacaggcgtgagccacctcacccacccagcaaacacagttttgaaagactttctagtaaagagcccaagaattaactgcccagagaaagaggatgtgtccccatcttacagatggccagtagaggcacccagaagtgtgatattcctgaaatcactgattcagtactgaacatctaagataacacagcgatttgctgacaaagatcacagtagactctgtgagactgtaccttgaagaaagaagggaagaataggggcagagaaggcccctcaggcctgcctggggaagtgggggaatgggagtgaggagaggcagaggggacaggaagaagcccctccagcagtaatcaggggagagaatggtcaagaggagcttgaaggacactgagagctggggactggggtccggtggttctccactggtatgtgggtgaaagtggagaaggaaaagtcgaaggagctgatgagctaaagaaatggcggaaggaagtagaagagaactggggaggccttctgacagaggtcagtgctggaaaaggggaaggtgggcacaagagatgatgacaatcttggtagaaacatcatacagaaaatgcaaacatccatctagatgaccttcagtgatggtaagattctattaaccttccagagttatccgctccaaatttagaaacgttttatttgtaaaatagaaattgccttgttgctttggtccatttcttctcattttaattggaatggggttggaggacagttggttaccactattaaaatgatgtgttttcactgggctcatagctctttaaacagactgagggataaatactctcccagcccctgttctaagttggcagacagacaggaggggccactaagacaacacctaccctctgcaaatcagcaccagacaaacactttagttggacagcagaaattatatctccattttccagaggaacagaaacatctaaaagtttaaatttaatctaacaagtattttgaagttcttgctacatgcaaggccaccctaagtttatttgtgacacgacagcatcttccactatgaatgaaacacacacaagaatctcagagtttcaacaggcgcccatctatctcatcaggctcattcaagaatcagaagtatcatttaacagtccagaaaaaaagacattcaggtgcctcgtggctgcttcccgtcttcaatcccttcagcaatcatggttctgagtcagctttcataacccacaatgacacatctatctgaggcacacattctgagataataatgtccataaatggctgaagataaaagaaaaaaatcataagacagtataatgggaatcataagacagtataatgggactcataacaagatataatttccataaaaaaccattttggtggcagcttcttctaaaaaaggtgatgaaagtaaatataacatctctcacataatgtttatgttctgtaccttgtatagattctatgtctttattaaataaatgaaaagaaaaaaagtccacatagacaaataaaataccacattagggcttttttttcccccgctcaatctggaaaattttgcaaaaaaggatcttttatttatggaagccctgactttcaaatcttatttaataagcttttaggaaatgaaagataccggtggctcatttagccatgaagggaagctgcaacaggagccagggcctagacttgccaaatgaaggtggctggaggaaagggctatccgattcattccgccatgaaggacttttacttagggtcaggtgaccaagattctctatgcaggtcagaagacatcagaaagcaggccgatctggatccaattcagcatctggcatcattgactgcctcggccatgtcacttaatcctcctgagcctcaattccctcaatggtgagataagcttgtttatgggactacccacctcagtaggttgttgtgatgattaaatgaagtgccatgctaaagggcctgatacctaccagacatacaacacaaaccaccctctttcacctcttcttattttccctctggctgaaccccagtggtatggcaagctaagcgtctctaaatatcaggcgcctcaactgcaaactgacaaaggataaagtatgcgaaagctttaaatcgctatgcaaatgttaggagatattgttattagtgccaatcggtacacctcactcgcaactgcacatcagggaataagagtaaaaagcatctctcagggagtttctttctaccccacctgtatactgctaactataaagcatagttcagcccccttcagggacactaatataaaagtgtccctgaggggggatgaactatgttttatagttattttctttttcattttgtgcatttaattaatgcttttatttctgtgctcatactcttgggtaaaatttgagaaaaccagaattggaaatgctaaagacaaatattagcaacaagcaacttgatatttgcatatccttgcaaagatccaaaaggagctgaatatgtggaaaacaggtagtaagataaagaaaaacaagtgttaagaacaaaagttctgtgagtttctctggggtgaaacttgcctaacaatcttcaacacccagcaaagtgtccggcacatggaaggtatttgataaacgatatttacaccatctgtaggaacaacgtgacctcagtctaccactgaccactaataaaaagataagcagaaaaccaaacctgaaaaatgaatattactctagctgatatgtgtttctattgactaatttattgatttttagaatggccatgggtacactacaggggtatatggtcttcaactcccaactatgtaaactctgaattccaactttaaattgttcaaaataaacagaccaaaacaaggcctctataacccccattacctgtattgttgagatgatgagtttgggcagaaacaaagcctggaatgaaacctcattcccgtcctccccagacaccacatacatcacatgggtgtcagagaatcctgtgcatctaatcattttcaattgtcatttcatctaggatgccaaatgttaaataatcaagactaaattttctctctgtctctctccatctttagtgcaagcagtatattatgggttaccatactattcttaatttctaatcatttttagtgtcttttctgccaatttgtaggcttttcctacctatcccagtgtttcttctggcctatgcaacacttgctttgcatgtatattatgccagagaaagggaaatttatattcaccacaattttgtacaaacaagcaaggcaaagttaaataaaaattagaattcagaagagaagcagcaatttatacagggttctttggccctctgccaatcctaaaagaactttgataacatcaaactacagaggtcccagcacctatctgtaaaaagagaaatacacaattctcagtactcaaaagcatcttctggtttgctatgctagaaaacaaaccaccctaaaacttagtggctttaagtagtaattttattatctttcatggttctagtagcttttactttgcagctgaagctggaatgatctgaaggctttttcactcacatgtctggcaccttcctgagaaggctggctgacacctctctccatacagcctttctggatgagtatcttcagcttcctcacagcatggaggtctcagagtaatcagctccttgcatggcagctggtttctcaggatatgaatgaaggctgcagtctctttaagactttgcctgggctgggcgcattggctcacgcctgtaatcccagcactttgggaggcggaggcgggcggatcacaaggtcaggagatcgagaccatcctggctaacacggtgaaaccccgtctctactaaaaatacaaaaaattggccaggcgtggtggcaggagcctgtagtcccagctactcgggaggctgaggcaggagaatggcatgaacccgggaggtggagcttgcagtgagtcgagatcgcgccactgcactccagcctgggcgacagagcaagactccatctcaaaaaaaaaaaaaaaaaaaaaaaaagactttgcctggaaaattggtagagactcatttctgccatattttatatgtcaaatcagtcatcaaacccactcagatgcaaggggaaggaggtatagaccccacttctcaacaggagaattgaattggaagccaccattaatccactacactcagattgccttgcatggtctgcatcacaaacagggctaatggcagaatgagccccagtggatcagatttgtgcacatgtagatgtccactcctgtaaaacatcaataatctttttttttttttttttagagacagggcctcacgctgtgtcacccaggctggagtgcagtggcatgatatagctcattgcagcctcgaatgcctgaggtcaagcaatcctcccaccttagcctctcaaggagctgggactacaggcatataccatcatgcctggctaatttttcattttttaatttttttgtaaagataaggtcttgctctgttgaccaggctggctgagaaatcataatcttaatgttgggagattgaaagtggtgctggtcaactgtgctagttaattatttagtgtgttttcatttcactgctatcttccaagtttggggaatttattagaaaaaattaaaaaagagttgcctttgatcactggcaatcatcaaatatataaatttattgcatgtattttataatgtcatctgggtaaaaaaaaaagctattaatattttcatggaggtgcaacaggtttaattccaaattttggtcaccgaaagacttcatggctcacctttttatactggtcttccaagcggaaatgaatagataattatgcagtcctggacatacagatttaattcctgttgtgaatattcattcagatgagcaggaaaacttcaggttattttaaatcaggatgagaaatcaatactactagtaccaaagaatatatctgcatataaaactgctcattaaagtcaggcaaggaagacatagctcccggaaagccccacttagaaattacaccgaagctgatccccgccagcaacttgttaatgaatatctctggtgttctaggccctagaagaacacacaaaggatggggcgagaagttttccattttagacggtgaccaagccctgtaggaactggttctgtctgaatcctttctttacccattcctgatgactgcttggtggcttttttgccttgggtgcctgctcttatagcaggtcttcaagcctgctgaggggcttcttgagaaacttcaaaccatcctacttgagttgtccttgctctgcaaagtccaaaaacaaggtatggccagtctaataaccctttctcttggagaagaggcagttcgtccctgttcaagagaaggcaggaatgacaggcagacatcaagttctttcttgcttaaccaacattaggcagacagggtccaccccagagcagcagtgtgtgatcactgttgacaggtacacagagaggaagaggtgagcagcagcaacgtggaaactgggttaagaaaaccccagggaaaaaatagatagctaattagagttttcaaattaatgtgcacaaactgaaatgaattttcaaagatgttcctcctttccttgtgccaaaatttaagtctttttctgaggtccagaatgttacagccaacagaacaacttggtgatagaaagcaatcatttttaaaaatcataaaagagattaattgagcccttataatgtgccaggtgagtactgcgactatcagcattttacagatgaggaaaatgagacacaaataactttaataacctgcccaagagcacttagaaagcaagagctaacacccaagtttatactcctaaccaccacacaaagtatagaagaaggagcagggcttttctgactaaacaagactgatatctaagtctaactctgccaattactgtgctagatatgtgactttagtttctaaactttctgagcttcagtttccttgccagcaaaatagggataataccatctaattcttataattggttgctgtgaactctcagaatgtaggttttcaatcaatggtaactatttttttgttatgcagaccagagggaacacagccaagctagcaaaaatgaaacacaagaatgggaaggaaacctggaagcatcaggaacatgcacacctcattttctgccaagcaggcaaactataccttggcgagaatttcctctccagagcctcaactcctctttttaaacacggaatgggcataattctgggagattttgcatatgcagtattcataactcagggaaacaatgtgcattttccttttatttttaactagagatacacaaatacatgataatatcatatgcgcatacatatttttacttacattcaatcttttgcaactctaatgggtccttaaatctgattccaaattaagtccttcagacacggctctgattaaataactagctggtttcagagccatctgaggattttttatgctaataggataaaatccagtctctttggcctaccttcctctacctttcacagtaatttccattctaatgctatcacacacacatatcccaccccatgcctcatcaggaactcttctataaaggacaaggcctctctgcctgcttgtccctgaacataaacatcttgctcattcccacctctgcatctttgcactggccggatcctctcagcatcacccactggctcatttcctccagttcaagtcctaccagtctgttaagaccctgctaaaggacctcctcttccagcagacctcccatgaccaatttggcccccattaatccattttgtttttctactgaattcctacctgtgcagacttttcagtttcatttctacataatttactactatgtaactttccttagagaaaaatcctccctcctcaaggatactatatgcaacttgagagagcacatggttaagagtacaggttcgcagtcaggcagatctgaagtcaaatcccagccttgccatattctagctgtatgacctggaggaagctacttaacttctccaaatcgtagttccttctctgtcaaatgggattataattgtagttatctcacattgtttgaaggggggattcatgcctggtaatatataagtgctcaataatgtcagctataattattatcactacccatttctcacacgtttttaatcccccacagcaccagctatctattaataatctatctacctatccatctatccatccatccacccatttatgttagagactcgatgaatctttaccaattgcctaacttagacgtaccaatccttctcaaatttccacttctccaagaagcacaaagctgtttctactttattaagccagcatcgaaactcaagattccccagatagggtctcacacagagcatgctgatttccaggagctttaaatgggaatgaaaagtgatcattcccttagttcagatatgctggtttgaagaatagctgagtaattcatgaggttctttcaggtgcattgatcagattctgctctttaagaagcattgtaccttgaagtaactatttgtcattccccttccaaatgagagctagataatagactgcatctgtttagcaaaactataacaaaggtctaaatgataataataccttagacctgctggatgcatcatagtttataaagcacgttcatacacatccttcatcgcatgcttccagcagccccaatcagataaccagggggtttatctcagtgtgctaagtgggactgctcaggctggagaaggttcaagagctttcccacaggccagttcattgattcagatcttccaactcctacttcagtgttcattttatggcaccacaggatttaaaactattcgcatatctttacaaagagatacccagctggaaagtgtgtaacccactgctaatttgtgttttggttaaagtatctatagtatcaccttggagatataatgcaaagcaaatctgtcaaatggtatttaatgcagttctatactacctgagactaagtggaagacctcagttgaaactctgtttttaaactagccattttcagtctttcgagcctgttttcctagaagtagagtaggagtacacagcatcagcctgctgggattccttgataccagactcagcctctactgtacttggacagtcttccttggtccagttttccaccagttttctaccaggctcccccttccttactgccctccagttgcccaacccgctgcctggctctttctcagacatacagagtatgtaccatctcagtacctattcatgggtggttctcagtgcatggcctgctccctttccttattcacatttctgcacaaatatcacctcctcagagaggtcctcaaaccatctaatcttattaacaaccccagacgcactctgcaaccactttccctactgtttcatcatagcacttaaccactactagacattttacaaatgtttcatctatttataactggtcttcagcactggaatgtaagatctaggagggcagggctttgtattgctcaccactgtatcatcagcacttgaaaaggtgactgacaataggaagctcccaataagtacctattgcataaaggaatgcagcctataaatttccctgtttaaaatctctacctcttccaatttgaaaagattcttatacatgaagccaaaagaacaaaaacaaatctcacaactaagataaatgcacaaaaaaaattagtgcatggatgggacaaagaacaagtgtacagaacccctaggattggaacagccatgactccaacaactgttacaatagttacatcactggacctaatgccaatcagttgattaaaaaaaaattagctgggcacgatgactcaagcctctaatcccagcactttgggatgtagaggcgggcagatcacctgaggtcaggagtttgaaatcagcctggccaacatggtgaaaccctgtctctactaaaaatacaaaaattagccaggcgtggtggctcatgcctgtaatcccagctactcgggaagctgaggcaggagaatcacttgaacctgggaggcagaggtttagctgagatcacaccactgcactccagcctgggtgacagagcgagactgtctcaaaaaaaaaaaaaaaaaaaaaaaagaaagaaaaagaaagaaaggaagaaaaagaaaaagaaagaaagaaaaaattaatgaccaacattccccttctaccccccaggcaagaggtctctcgttgcctaaggcaatttcatcgcatgcctcagagtaagcaaaaactgacagataaatgtcctaggctatctttttgagaagaaggtccaagttatttcctggatttttgcagatatgacagtaaattggcaactgagggaataacaacctgacatcatgtgcccctaatctgatacaattagagctactcatcatcagccatgaaatgttcttgctaaaaatatgtaatctgaatgtaatcatgaggaaatcatcacatatccggaatgtagggcattctacgagacaactggacaggtctcttcaaaaatgttagtatcgggaagaacaaataagatgtagaggctctactagattaagaaaaaaagactcagttggatcctggattgcagggggaagctagaaaatcgaaaaactagagaaagctgaatatggatggcatagtttacaaaagcttcatcagctacatccatttactctacaatatttaaagccaatgtccaatttatcactattcacccctgcaagtaatcattaagcattttccatatatatcatgtccttctccaatcacatacatctcatcacagtaatatctatatcctgaattcagcagggcttagcctccacagggcatctttaatactaattggaggagacaggctttataaatccttatttacaagatgattatgaaaactatatttcctaggcctgtcctttacgcttctattattctctctctttctttctcttgccaataaagttcttattaaatgctgcttcagccactaaattgtaaattccctggcagtagaaatgatacctggttaatctttgcatttctaagaagcaaacaatggcttacatagagtacatagctcataaatgggttgttgaattttcgaaattactgtactttaatttagaccacataatgactatttatttgcttcaatttttaaatgaccctgaatgtctctgtgctacaaaatgtactgaggcactgtacatctttcagattttggaacttgcattcagttgccaataattttatatatttcatgaaatgtttaacaataaaactactctttgcatctcaaaatatgttttgaagaaattatgaaatcaagatgttctttcaatgtataaaatattcaataagtgactcaataaattagtagcatatcttatttgaaactgagatgccattaagagcatttagtaagctgttttgaatactcttatctatctctgctaacaaaggcttgtttcaccaagtaacttgggaagtcatcccagtatcatgatttatacacctctccccattcatactaaatgcatcttcactaaccctcttcaatgagaacttttatagttacttatttctttagaacttattgaattgattctcgtattgtgaaaggtattataacttatagttataaaaaaaagttaaaaatcatttaacttttgacttctcatctcatgcctagctttttaaatttccatttctatttgtgaatcttgacatctgtaagcctcctggatcatcaggctctgagacagtcacattctactttgctgaaatcagattgctcactgaacttcaataagtatgtttctttaatacttactagcacccttttgtgacaatccccaagcccaccacctcactgggacttcaccccttcctataatcaaagggctttgaaagacaagctttctctaaggctgcatggcatttcccaaagaattaccatgacctagttttgaactccagatagacttcagccagtgggaaacaatatacgaagcatctttatttcagcaactgagcctcattccgaagaactgctccctctctgagaggttaccccagtggaaaatactgcctgagagaaaaagagattacatgtgtggtctgggtccagccatgacccagctgtacaatcctgggaagtgagtcagtctctgaactttgatttcctcatctttaaaattaaacagtgagactaggtcacctctcacttgccttccagttctaagattctataattccatcgagtgttcctatgtggagcagaaaggggaaacataattatcaaatttcaaaaatacggcataaaccctttggtaattcttctgtattctgctacctctacgtattttgagtaccctggcaacttccataaggacttacaaaaccttagagactaaaacgtgggccaaaccgtatgacccagcaattctactcctgagaaatgaaaatgtatgtacacataaaaagttgtacacagatgttcatagcagcattattcataatagcccaaaggtagaaacaacccaaatgtccatcaactgatgaatagataaacaacatttacagtctccacacagtgaaatattatttggtcattaaaaggagtgaaatactcatacatgctactacaaggatgaaccttgaaaacaatctaaatgaaaaaagtcagtcacaagattatatgatttcacttgtatgaaatttccagaacagagaaatctacagggacagaaagtagattagtggttgctttagggtggcgtagggagaatgaggggatgggagatcatagccaaatgtccatcagttgatgaatagataaacaagattggtatatccatacaatggtatattattcagccataaaaaataataaactactaatacctggtaggtattagtctgctagagttaccataacaaaataccacagactgggtggcttaaactacagaactttactgtcttacagtaatctcagatcgtggtccagctagaaatcccagattgaggtccagcagggtcagtttctggtgagggttctctttctggcttgcaaatggtcacctttccactgtgtccccatatggcagagagagagcaagctctttggtgtctcttcttataagtatattaatcctaccagattagggcccaagcttttgattctatttaaccattatcacttcttcaaagggcccgtctccaaatacagtcacactgaaggttagggcttcaacatatgaatttacaggggatacaaacattcattttataacatgtaacaacgtggacaaaacctgaaaacattatggtatgtgaaagaagccagtcacaaagcaccacatattgtataaatctacttagagtaaatgtccataatgggaaaatccgtaaagacagaaagtagattagtgattgtttagggctgggatggggatagagttgaaggaaatgtggaatgatgtttcttttggaggtgacaaaaatgttctaaaattgactgtactgatggttgcacagctctgtgaatatacaaaaatccattgaattgaatacttcaaatgggtgaattgtattctccatcacaagaaaactgtttaaaaaataataaacaaatagacaaggctcaagatgattgcctaaggatgaaaaaacaaagagcttttgaaggaagtcctgggctcagatcccagtgctcccactcattagctgtgtaaccttgggccagtctctgaacctccagttcctttactctgtgacgtggggagagcatggcaattgttctcagttggtgtgaaaatgaaacgaggtaatgcacagtgcccgacaagtatcctaagcacttaataactaatggtcattgttgaatattattagcatttcatcagaagaatagcccatctgttttttgaactgaattgatttcaaagctcaggcactgaatttgaccacaagtttttagtggctactgcagaagtggaagcactcatttttcaatatccaacaacagagtcagtgccacttacctataagcttgctgttctatgaacatgtttgtgactcgagaagaggcatgtcactaaaaccaagatggctttttagcatctttagtcaagggagataccagtgtccaagtgatcaaactatttcatgcccggagctgacagtcaatatttgctgactgatcgacttagccatgcctgacttatgagggtttttatttcaaccgatgtttcattaagtgttggtaagacaggcccaactgtccctgggcctctggagccttttgggatatgcagaagaaacagagttggtccctgcctataggagtttgtattcaagcatctagtcctaaactgatttttaagtttatgtttactttaatgttaccactattccaactctccatgtgaataaacaataaaactgctcagtacatgaaggcaagcagtaaaaaggagtttttttacactcaaggtaggcccacctctccagcacttctgaggcccagttccaatccaaaaccagtggaaagaactctgggccaaatgctgaggacatgagagttctattcccagctataccacagaatagctatgagtgcaagactcctcctttatctgtagagaatatgtggatgcctgaaaccaagaatactactgaaccctatatacacaatttttttcctatactacatacctatggtaaagtttaacttataaattaagcacaatgtgagattagtagcaataactaataataaaatagaacaattataacaatctgccagcatcactactcttgcactttggggccattattaaataaaataagggttactcgaacgcaagcactgcaagactgcaacagtcaatctggtctgacaaccaagagagctactaagtagactaaagggagggcagcatctattgtgtggatacactagacaagggcctgattcacgtcctgggcagacagagtgggacagcttgagatttcatcatgctactcagaacgatggacaatttaaaacttatgaactgtttatttatggaattttccatttaatattttcagatcgtggttgactgtgagtaactgaaactgtggaaaatgaacccacagataagggggactacagtacaaatcctacccttttgtactgcttccatcactaagatatgaaagaccaggttagacagtaaactaagtctctctatcacctagaccaaaaaatgcatattagttctacataaactaagtgcctttgatagttctagttctcactgtaatttaataaactggcacaatgttctaaacaagatgtagaaactgccttccactccctgcagacacacacacacatgcacataccccagaaaatacaaagtgaggtccctgagcctgactggcagaactgacccattgtgataaattcacccatctgaaatgagtcctcttgggaaagagtctaccagcttatcctctagaattcacgcccctctttccatagccccttcatgggcctgtgtataagggagctgtgatccaacttggatacatactttccttctgaagtcatggtaccaccagcccttttgggtgtgggtgcctgtggttgtacactgtagttctcagctatttaaaaatatatattcctgaaatttgttcattctcacctccagctgtactccaaccataagataacatatgaagatgctaacctcggagccaggctggtttgctggataaaaagcagagacattgaataagaagacctagctctgctcctgattagttgtgtaatttttttttttttttttttttttttgagatgaagtctggctctgtcacccaggctggactacaatggcgcaatctcagctcactgcaacctccgcctcctaggttcaagcaattatcctgcctcagcctcccgagtagctgggactacaggtgcgtgacatcaagcctggataatttttgtatttttagtagagacggggtttcaccatgttggccaggctggtctcaaactcctggcctcgtgatctgcccgccttggcctcccaaattgctgagattacaggtgtgacctaccacgcccgaccagttgtgtaaatgagacttaacttttctgtgctttgtctgtaaataaagacaacaaataatattattgtgacactgaattaaataacatgattaatacagaaggaactagcaatgtgtccaccaattacagaacatcctgtaaagtcagtttgactaaaccattggatagatcctttctcaggaaagattaagtctcaggaaacattaattttaatgcactctctggaaatgttaagtaaaatataatatatattaataaagtagtaaaagacatacataaataaaatataaactcccttacacatacttacacacaccacatgtttatacatatgaattcaaaccaaacacactgtttacaaatggccatttatttctgggaattagtaagtccaactgtaaacataaagacaatatttatatggtcaagaaaaccaattcactagcttcagttttaactcaatttattaattttattttttaaactctactttctcaaaatgccttttttgttttgttaatgtattttttaaatattatcaaaatggaaaaaataaacttacttttggaaatcatgcattcagcaaatacctactatgtactggaaactgtgctatgcactgagatacaaagatgaataccatgggaccctaagttagccttgacccttgaagagctcatagtccaataaaactgtgttaaaaacaaatttttcaatcaaccaaacattctcttcattgatacaaaggagttctcattagtgagttctcattagtgctctaacacttcctagcccggtggctttgaacaatggatatcttcagaaccctgggatcttcatctgcacaaatgaaaaagctgaactatgcagcctgttgcatcccttctccagtgaaaatatgtgattctaattgccattttaagcccaggttgaactttccctttttttaactaccttccatggctaaaattacaggtattttagacaatgtgcaaatgagtcaatacgtgacattgtgtcaacatgtgcataggtatttattgcatagctatataaatctgggcaccaaaatctccttaagctgataagcaacttcagcaaagtctcagggtacaaaatcaatgtgcaaaatcacaagcattcttatacaccaataacggacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacatttcatgctcatgggtaggaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcattgccaagtcaaccctaagccaaaagaacaaagctggaggcatcacactacctgacttcaaactatactataaggctacagtaaccaaaacagcatggtactggtaccgaaacagagatacagaccaatggaacagaacagagccctcagaaataatgccacatatctatgactatctgatctttgacaaacctgacaaaaacaagaaatggggaaaggattccctatttaataaatggcgctgggaaaactggctaaccatatgtagaaagctgaaactggaccccttccttacaccttatacaaaaattaattcaagatggattaaagacttaaatgttagaccgaaaaccataaaaaccctagaataaaacctaggcaataccattcaggacataggcatggacaaggacttcatgtctaaaacacccaaagcaatggcaacaaaagccaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctataatgaactcaaacaaatttacaagaaaaaacaaacaaccccatcaacaagtgggtgaaggatatgaacagaaacttctcaaaagaagacatttatgcagccaaaagacacatgaaaaaatgctcatcatcacttgccatcagagaaatgcaaatcaaaaccaaaatgagataccatctgacaccagttagaaaggcgatcattaaaaagtcaggaaacaacaggtgctggagaggatgtggagaaataggaacacttttacactgttggtgggactataaactagttcaaccatggtggaagtcggtgtggcaattcctcagggatctagaactagaaataccatttgacccagccatcccattactgggtatatacccaaaggagtataaaacatgctgttataaagacacatgcacacggatgtttattgcggcactattcacaatagcaaaggcttggaatgaacccaaatgtccaacagtgatagactggattgagaaaatgttgcacatatacaccatggaatacaatgcagccataaaaaatgatgagttcatgtcctttgtaggaacatggatgaagctggaaaccatcattctcagcaaactatcgcaaggacaaaaaaccaaacaccgcatgttatcactcataggtgggaattgaacaatgagaacacatggacacaggaaggggaacatcacacactggggactgttgtggggtggggggaggggggagggatagcattaggagatacacctaatgttaaatgacaagttaatgggtgcagcacaccaacatggcacatgtatatatatgtaacaaacctgcacgttgtgcacatgtaccctaaaacttaaagcataataaaaaaaaaaaactgggcacatgttactaaatagagggaatgactacaatcacccaaatcatttaaaaccgaactctttacattaaaattctgagttcgcataaactggtatgttgcatttatatgcactcccattcaatttatgcatgattaatttgcgtgttttggagcaaagaaatgaaattaatacttgtttttaatatacatgtccaaatatcaaaagccacaatttaagccagctgccaaatactgaaagactggtgtacaaactaacaattcttctcagctaaacattagtaatgttataaatagtaacattagttcacagcaacacaaatgccaactttttaacacccctatggctaaatatacagaaaagtatacataattagatagactatctacagatttatttaccatgctatatttattacccattcctgcagagtatttacgtttaactctgtgaagcaaatatccccacaataattttttcctccacattttaaaaatattttactatgaacaatgtggattctatttgtccaaaaaaagggaagagctgggcatggtggctcacgcctgtaatcccagcactttgggaggctgaggagggtggatcacttgaggtcaggggttcaaaaccagcctggccaacatggtgaaaccctgttcctactaaaaatacagaaaagttagccaggcatggtggcagacacctgtaattccagctattcgggagactgaggcaggagaatcccttgaacccgggaagtagaaattgcagtgaggggagatcacgccactgtactacagcctgggtgacagagtgagactctgtcaaaaaaaaaaaaaaaaaggaagaaatgacagcaccatgcatgtaaaaatgcattctttttaaacatcaaaataatcttggacagcgctggagagcatgtggagaaataggaacacttttacactgttggtgggactgtaaactagttcaaccattgtggacgtcagtgtggcgatttctcagggacctagaatgagaaataccgtttgacccagccatcccattactgggtatatacccaaaggaatataaatcatgctgctataaagacacatgcacacatatgtttactgcagcactactcacaatagcaaagacttggaaccaacccaaatgtccaacaatgatagactggattaagaaaatgtggcacatatacaccatggaatacaatgcagccataaaaaatgatgagttcatgtcctttgcagggacatggatgaagctggacaccatcattctcagcaaactatcgcaaggacaaaaaaccaaacaccgcatgttctcactcataggtgggaattgaacaatgagaacactcggacacaggaaggggaacatcacacactggggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtataataaatatatatatataaaatcatcttggaatgtatacaaaattattttaaacaggaatgagttttattcaggtctaccttgcttcaacctccctcctttttgaactggagccccatcctctccagagtctccagggcttctccactcctgggcacctgtcctttagccccttctcaccacactctgccactgtcaacccgtctttactttcccggtaaggccacagtctcctgaagtccagccttaggcaaaggtgacagaggaaaggagaggttaaggtcgctggagttggagaggtcaatgaagagcgagattcaggtgttgaatggctgcctacctggacaaataccactaaaaaatgatcataaacaaaccaatgagcaaatggaaaacagatgtaagatcgtccaagataagtggaagtgcccagggtcttggtagatcacagacgaaagggatacagaatgataaagcataaaatttgggagctggattaattgatcacaaagacaccatctattgctaacatccttttgttagttgatgtattattctagctgggccgtaaacacatctcaggaatcccactgttaatctatatcttcatcagactgcccagataggtctacttcatacctttcctgccctcctgaaatccccagtcagctcctctccatctcagcagaaaagctggcttccttctttactaagaaaaatcaaggtcatcagaaaaaagatttcctcgcacattctcctttccatctcagctcttatgtttcttctcttcctttcttcctatttgagaaaaatccttcctaacttctaagattaaatcctctgcctttgatccccttttcttaggcatattagattgcctctgtaatctactagcttatacgcttattaaccatgtgcccaatgctcagtttcctcagctgtaaaatggagtataatgcccaccgtgcaaggcagttataagatttaaatacaacaacatattaaagcacctgccacagagcagggtgcataacaaaagtgctattattattaccctctaagccttgtctccctcaatggctatgcctgctttctctcgcattagttaaaaattcacttagtgctacctttctaaaaggcgttttagccactggtactataacaacgaacaaaatcaagggaaagatggctcacccttgtgaagtttacagcctagtgggcagggacaggaataaaatacttaagtcaggtgataagcgccatggagttacaacttataaaagagtgtcctgggaggtctcacttaaaagatgacatgtgaacaaagacccaaaagaggagaaagaccaagcaggtatttggagaagagcactcctacgtgagaggacgctgcagtctcctggagggcttgagcttgaggaatgaggagggtgtgtgtttggtgctgggggctgggggagcaggtcaggtttggcagggccttgtaggttactgcaaggaattcaatacttactctagtgaataataaaagagagggggaccctggtggattttgtgcagtggcattatccaacttaagctttattaggatcactttagacactggatgagaacagactcaaggtcaaggaaggagaagggagatgagttcggagactttcaataattcaggagaaagttgatagttgcatagatgtgagaagtagttggattatggctatatttttcaagaagataaaataccaaaaaggttttctgatggatctaatgatcagtgcagagaaagagaggagtcaaagttactcccaaggactaggcccccagaaaccagaaaaatggagcagctctgtattgagataagcaagactgcagggtcatagctttatctctcccccaccactgcttcctgccccctgtggtcaaccgaccaaaggtcttcctcactttaagaaaagaaagcatgttagctttctgctgtcctaatctctcttaatgctcgacactaaatttcttgaacaattgctctgaatccagggtcttcactttctcaagggctccgcccccacccccaccccattccactacagataactctgcttccaaagagcactcccgcagggcaaccagcatactctagtcatccaggccagtagctgcaattctgtgctgcagcatttggcactgcccattattacctccttcctcaaattctctccatggtgggagatctaacatcctgatttacatgtgatggctgtgatcattccttccatagcctcctctttctctttcattgtctcctcctttttcttctcttctctcaaacacagcatcctctgaattctgtcccttgtccccctgaagctacactgccaagaccttacactcatagtctttatgactgtttatagggtctctagcacccagttcagtgactgagacattgttaattgaacaaatgaatgaatttatcattccatcaagtactgtattcctatatttagtttccacctgtctcccaagctccagctttagatccacaaccacgagctacacattccagttagaagtcatcctgccctacgaagttcaccaagccaaaaccaaacactccatcttaaccatccctccacaaagcaagctgcgttattttaactgccctacttattttaagggtatcatgatccccaaataagaactttcacctcttcaagcctaggatatctactagagtctccctctgccctctacaattcattctacaatgccaccagcttaattttctaaaacactattgtgcccatgtcactcatctaataaataatatttattggctccacataaccttcagaagttaagagagaagaagggagagagagcaaaagaatactagctagggcctgattttggctatttctattttccttttaaatatgttttctactaggtacattttcccctttgaaattcttagattaccccacctccagttccttgcctaggcaaagtacagtacaactcttcaaccagatattaaacatcttcaaaaatccagcccctattagcctgttcaatcttattccctaatacagcaagaatcacttcttcctttcagatggtcttgccatccctcaaacaagcattttacattcttacctccatatcactgcttacacaattccctctctggttgttctctcctccatcccctcttctctactctatgttaattgcccatcaaggtcttgctggaatcctacctcgccccagaagcctttcacatacattctaaccaagagtggtttgcagcattcctcccccgaacaccctgcaatttgctgtccttaccactcctgtgtggctcatcacagtgattctaaaaatgtgatcctgaaagcagcagcagcagcagcatcattttgttaaaatgcaaattttggggacccatcccagacctactgattcagaatctctagaggtagatagagcccacctccctgtaatttcacaagctccccaggtaaggctatgcacgctaaagtttaaaaactagtgacatgaaataccgccttacgttgtttgatcttgtcaactaaataatatgcaaaacaccaaatacggtatttagcatatagctatccctcaagaaacttgagttttgcaatactgtttcaagtagtttcatcgcaatatacatcaagtgaattttacctctacacctaattttaaaaaacaaaagtaaaaacaaaatgcctttacgctaaacaatgaaaatactttgttttttaacgtgaaccaagaaaataagccctgtcatagtggctcatccctgtaatcccaacagtttgggaggctgaggtgggaggatcctttgaggccaggagtttgagaccaacctgggcaacatagggagggtctgtctctcaaaaaataaaacaattagcccggagtggtggtgtggacttgcagtcccagctacttagaaggctgaggtgggaggattgcttgatcccaggaatttgaggttgcagtgaactaagattgtgccactgcattcagccctggcccagagtgacaccttgtctcaaaaaacagacaaaaaaaaaaaaaaagaaatgaaattaatattgttttaatcaagagcttgtttaaaatcatttaatttaatattaaatgaataacaaaaataaatgtttttatttagtaataaatcatttaatattaaatagcttaatcttattaattggatgagaatcttcttttacatttcctttacatttcaactttggaaatatagttgagttttcagattacaccttcatggtgaatacaggagaagatagctaaataaaaattcctgccaagagaagagtagaccttaattttaatcaatttgcatgttgcagaagataaaaagtagagccacaccaagctgaaccagatttaacattatgctttgaagaaacccagtaataatgaattacgcacttatttcataggtccgtcctgcttgttttggctctttagaaacctatatttcagaaaggttaaattaattaagcaaagaatcttcttttgtaagaactttcttacaaaagaagagcccaaaatgaaaatgttgtctcctacataaaaaggaaaataatgattaacataaaaaggtcttggaatagtataatatgctccatttatcccccatatcaacaaactttttcttcatgtctattgcaaacagaatacagtggtagctgctatgatagatcttgacgtatttttatatatttagcgtctttagagttttattgccaaaatgtccagggttccatacaagtacattctttttaatataattttctaataaacagaaatactggagagaaatatgccaaaatattatcagggattcctctgataattcctctgagtgaagattttacatgttctttttactctctatttactgttcttgtaatattcaatttttttaatgagcctacattaagttttaaaatctaaaaataattttaggaccatatttttgttttatgcatgcattagtacagtaacttacttctccacttaggaggatactgcttttgcgtcttttttttcatatatcagtttgtttaatccacacaacaaccctatgaaattggtaaaatcattattcccattttacagataggaaaactgagtcacagagaaatttagtacattctacacagaattcaaacacatgaagattaacattagagtttgctcaagtcacccaccaaaaggctgccacccaggctggcaacttacatcctgccttttggcaaatcccaagactagttaattacctctttttgagaatgcatacacagaaacacaacaataagcctgtgtgacactgggaaatgattgattttccttattttgtattgtatcttgacaactcagaagaaaacatgcaaaacgtaatatataaaaattttagtatgcatttttaatagtgtttccaaaccaaaagaactctaagagaagatggcctccttaagacaagaggcaatagccaaaagagaagaaaagattgaaatgaggacacaaatgaaaagaaagaatacaaggaagcctaagatgcaagaggaaagctggaggcaatacagaacacaatcgacttgtggaaaataatacctatgctgtgaaagacaaacatgatcacaaccagatgcaatttcaaaagacggatacaaaaataaataaggaaaaggtgatagagagggaacatacagcacagagatccaaactaagtaggaagaaattcaatagtaaggaacagaaccaaaaataaaaatagtaaagataaatattcacatgtggacaaaaacctgctcccaggagcaaaactacagtgagtactaagcaaaataactgaaaacaaaccctatatctatgcctaaaaaagtaatttccattattttcccaaactcatagcactaaccagacggaaaatcaggttaactacaaagtaatagatatcaaattagccctaagcctctctttcacaatattaaacaccattagcctatgaaccatctaagtttggtagcaaaagtttatgataaaatccttgtattccctgacaaattattgttcatttaaaaaaggcaaaagaaacattttaagcaatgtgaagcctcataaaacactgcacgtgtataacattctcataaaaatctattccaagtatacattccagctaagtgaataaaaactcaaaataaagaactcaatataatagagcaggaaatgcctaatttcatgtaatgaccaatttaatgcaaaaggctaaaagcatccttgaaaaacaatgagttgtacttaatatcttcacattttaatttaaaacaaaaaataagaagcatataatattaaattgatatcagataatataatgtatttttaatctatagcatcaaattgaattaacaaacactggaaggatgaggtcagtgtaggagaaataaaatttaacttgactcttttttatgtaatggggacattaaaggattccttttttaattaatttgcataattagagaactacaggtttaagtatatattcaaattggatttttgaaaacagtctatatagaaaaacaaagaaaacactaaagaaagtagaataaataaaatgagaagagatcaaacacatcatttatggctgtaaaaccaaatggtttaaattcctcctttaaaagaaacctcttacattgggttcaaaaagtaaatcttactatatatgctgctttcaagtgatacagcaaaaacaaatcaagacaaattatagaaagaaaaggaaaatcatacataattgagcaaacacaaagtaaaacaaacaaaacaccttatgaaaccagatgtaattcttaggaaaagtcattacctgaaacagagtgcttatattaataaaaatcaaaatctactgtgtataactgttaaaacttttatgcggcaaatattgcatcacagacacagaacacacacacagacatacacacacatgcacatacacgtgtgcaacaaaaacacaaattataacagcagattaaaaagctattcttatctgatatttccaaataaaatttaaaataattttttcagatcctaaaacaaattcctgcttgatatttttattgaaattccatattaatatgggaataatattactaaattttcctattcagaaacatgagatatttttgcattaattcaggcctttagtatgtcccttgttaggttttaattttttcttcatataagtcctgcagatttcttattacattaatttctagatattttacacttattattattaagaatatctgttttcttttctttttccttttttttttttttttttttttttttgagacagagtctcactctgacacccaggctggagtgcagaagcatgagctcagctcgctacaaccaccacctcctgggttcaagtgattcttgtacctcagcctccctagtagctgggattataggtgcccagctaattattttgtatttttagtagaggcagggttttgccatattggccagactggtctcgaactcctgacctcaggcgatctgcctgccttggcctcccaaagtgctgggattacaggtgtgagccaccatgcctggccaagggtatcttttttcaaatatattttgtaattgattgtttttcttggctcacaaaaatactattgatttgggtatatttattttgtatccagccacattgctgaattgttattgttctaatatatctttagttgattctctaagtttttgaggtatcatctgtaaatgatgacaaggttgtccctgtcatcttgtaactcttttttacttatttatttatttatttatttattttttttgagacaaagtcttgctctgttgcccaggctggaatacagtggtaccagcatagctcactgcagcctcaaactcctgggctcaagcaatcttcctacctcagcctcctgagaagctaagactacaggtgcataccactatatctggttaattttttaaaattgtttttagagacagggtctttctatgttgcccaggctggtcttgaactcctggcctcaagccatcctcccaccttggcctcccaaaacactggaattacagacatgagccactgtgcctggccctcatcctcttataattcttgtttcttttatgtcttgcctttattcaatggctaacatttccattacattatatattattattggttattatctgattcctgacaccttgatatcatccctcactttaaaaagaacatgcattaattaggatgtttgcaactgcaagtaaaaaaaaacacacaactgagagtggcttaaacaatgtggaaattgtattatctatataatatgaagactggagtcaggccagttccagggttgattaattcagatgctcaataatgtagggacctgatacgtttattctgtgattctcctggctttcccctcatggttgtcagatggctggagcaaacctaagtatcacagtctttagataatatccaagtccaggatagggaagatatctttttacatatttacttgtaaaagaaaggaaagccttcccaggaacccccagtgaggcttcctctggccttcttattggacaggttgtgttgcatgacttgcttaagccaatcatcaacaaaaagaatggaatcccaatgactggcttaatctattctacctcccccatgctggggaagtggaggtcaacttcctctgagaatgtggaaaggtaaacaccaaaacacatccagagctctgtgagaaagaaaaaggatggggatgactgccgggtagggaaccaacagtgtgcaccacagagagtctctggtgtttaaaggataggtacagggatgactattggttttagacatattatcaagttaagaaagaatgtccttaatcctagtctattaaaaatagtttttgctttgttttttaatcaaaaataactgctaagttgtaccccatacctttttgacatccattgaaatgatcccataattaatgtcctttggtctactaatatgttgtattaatagacttcctaagacagaaataagggggcttacatagcattttctgtgttttcagttccatactgttaattagcaatttttagggtttttcatacaaagcaagaaacacacattattgcttattaataaataatacttcacatataaaaagtttccagatcctaagccagaaaaattgaagagggagaaatgaatcagagggtgacaggcaagaaagacagacagaacaactcagacatgaagtgatatggcttgttctggagtgggggcagtagggcaggaaagcatggaaggaacacaaagcttacttctaagacacaacacatgcagacttaatctatatcaatattttacatcaatggcattctcatcatagcattgggaatcactgagaattgctttaagttatttcagctccatgaaactcccactcctgaccttccctccatctggtccacttccctccatcttccccactcctatacagctagccatctaccctggtgctctgacaatactctttatctatttttacatctgtttttaccactacactttgaacttcttggaggcagaacctaataccttgtaaacctacatatacccagttgcttgcactgcaccagattcagagtaggctctcaaattgtttgcaagagtgatgctgatgttgaatgtattgaacatttattgtgtatttgcaacatggcaggcactgtcataaatacttaacataaaatatgtctttttaattccagcaatagtcctatgtgtactgttattgttacctccatttcataggtgtagaaaagtgtagggattttacataacttgtcacaagctgcaaagctagtaagctatagcaccaagattcaaatccagagagtccaacccctgatgtaatcgtaagtcattttccttcctgtgactttgaaaacaaatgagataagccagaagctcacaaatgagcccaaattatttcatggtcaccttttatacacgttactctctgaggtgccaaaaacgttctggctaaatgctctgccaaggtgtcatctggggaatcctaaccagacactagaggctatcatcattcatttacatgccttgattttcaaaagactgagaacaggttgaagatttgaacattgcagcacaaatctgcatcaaacagacagtgtatctacctttcatccccatccccagcctcacacagagccagtgcatttgcccccttggatcatttggcgaggctgtcaagaaccttaacacccctcaaaaagaatgaaatcaagcacagcggcatctgtgccagttcctctctttttttattactgcccccaaagcctataaaagcttggaatctattaattctttctttatagctggaatgtctactcattattatctgagaaaggaagagtcaatttaatacatttgatttcaaagattctatccagtgaagtcatagttcattgcagtcatatcagctgattactgtaaagtgcaacagtctgcatttgtaaaggaaaaaagcacccaagcttagtaggaggtacacagtagagaacgtgggagacatcgggatagcatttgctgctgaactgcattttgcagacctgaccaccccttccactttgctctgttccaggaatgccatttaactgtcatgggccttatccccctatagctgtaggataaccacaagagccagtgagcactcactaaagctaatcaatatttagaagctaaaaatgaaacgaagaaacacacaaatgcaagcataggcaggggaggcttttaccctgtgcctccaagacctatgtctaagctaatacatgcaactgcttctgggatttatggctgcatttattcaaaccctgtagcctctgaagaacagctcatcctctccttccatattagattggaccagccagaggcaggcccttctctgccaacagtcagggaggtgagagtaaatctgccaccatgtagattccatcattctcaactcctatcaggtaactgaaatccacctataatctgtcacccatgccaaggccatgtttgaacttcatttgatgccctgtgttagaaagaatctttcttgctcacatgcttcttaaaagcagaattagatggctccagatgacttaaacaaaaatctgagggcctacaatgtgccactaatgacaggtgctgaggaaatccggggagttgataaccagctaatcagctagctagctatccacgccatgaggcggcaaaatgtcttttcccatactttcctgttagccactggggaagctgccccacagacagtgctttttagagtgcatagagcagacatgggaatataactgctgcacctgcacagtgacttgtcgccaataaaaattcacctgtgtctcatttattgagcctgtacttataaagaggtttatagtctgttgtcttaatgaaccactttaaagtctaaaggggagatagaagagcaatgagtagaggccatttcaccatctcagggccctctcagtttcttccccttgcatagcacctaggaggtttctaacaatgcaagcattaagacccacagctgcctaggacacaggtctttccatttcccaggggtcctgcactttgttaaggtttggtttcccagaatcacaatccctcctcttaaaggctaaaaacacatgaaattgtattttcacaactgcatagcaagtcgcctgtccactcagttatagtggggatgcaggatccaaacacgatgactcccagaagacacgtcctggtgaattacgtgttaggcacactgcagaatgcaaatgtaaacaagtcacttgagaaagtgtcttaagttcctgcccttaagaagcttataatttaaatacaccaatggcttgtggacaaatcattctgaagcaaaacagagatgcaggtgataaaaagtgtgaacagagcaaggcagaaaaacaaaagtaaggattaacattaaccaggggacctagatgatgaaccaaacctccctgatatgtttttcataagaaagtgtcttagtaacaggggttttgtggctcgatcaggttaacaaaaggaagagtgtgtgggtttccagccctgtccaaccaccacttgtggtgggatcagaatttggactccacgctccaggttcaaccccagcctcattccaaccctgtcaagcacatttctaatcaaagtttcagagtcctatgtccctccaaaatcagaagtacagttccccagagagcagacagtagttctaccattagaaaagcattcccactatttatttagaaaatgggaagcagcaatagcacaatgcttacatttcatgttttaaaatcggactagccaggcacagtggctcacgcctgtaatcccagcactttgggaggccgaggcaggcggatcacaaggtcaggagatcgaaaccatcctggctaacatggtgaaaccctgtctctactaaaaattcaaaaaattagctgggcatggtggtggatgcctatagtcccagctacttgggaggctgaggcaggagaatggcatgaacccgggaggcggagcttgcagtgagctgagatggtgccactgcactccagcctgggtgacagagcaagactctgtctcaaaaaaaaaaaaagaaaaagaaaaaaaattggaccaaactaggttcaaaaactggctccatcattttcaataaatcacttaacctaagcctcactttccacatctataaaattagaatagtatatatcacaagatgtggctgcattaataagactagacttttattaaaataattaacccagtgcttgacacgtggccagtggtcacaaagtatattagctataaatattggtattaaattttgttctttctcatctcccactgcttcaatcgactagcctaaatgcatgtgtattactattattattatataaattacactccagatcagtgtcaggtacatccacatgttggtgtgacctgagactctatcctagccacatttcagtatagttcttggaactgcaaagcttaggaccaaatcctggaccacaaattcctcgctgaaagtcttgccctaaccaaggccagcatgtgccactggcctgtgccacccacccacctggccctcactcaacacctagcacacacagccctcagaagctcagcatgtgctcagtttccactggtttcatgaacattctactcttgtctcccagctgctccgagggaagggccatactctccccattactcaacctcactgtggcacatggtagaagcctgcacagttttcctgtacataatatgacagtgtccatgatttttctctccctctgtttttatgatagccaagaccatgctaggctgggcgaatgaccacaatgattactggagctgagcctccacccagttctgcagactcttaagccctcttcctttctccacatttcctagagggtattctcaaggccatggtggctactgcagtttccagcaactcattcctccttgattactgcccctttccttccctcgccatcatagtaatggtgagtaacagtaacagtaaacataggaacatttttctactctattctaattttttttcaaaatctgattgcaacccattaaactcactccacaacccattacaatttgaaaaacacctggtatctgtgattccaggaagatgacatgctaaaaggagctctgatcatttgagaaaaggaattccccaactttgtgggaacaaaagagctgagctctaggggtaacagtggaggaaataaagtgtatggaggtggaatggggtggtagttactgatactgtagaaaaatagggaatggttagatcatagaaggtcttgctaagttaaggagtttagcctatgctgtaagtcacgagcaggcattcatttcattaataaatggatacaaggatacacaaaacatagcttgcctttgtggagcttatagtctcttctgcaggaagagggtgtggagggagacaaccaaataatttgttaacaaatgaacaaatggcacattatgataggggcttgggaagagtttcaggcagcaggaacagtgtgcataacagcatagaggtgagaaaagcatggaacattaagaaaacagaaagagttagtaaggaatggttttagacaggaatagctctcccagtcctggccccaaagtcctttctctacaggaggaataagttatttgagctaccttatcttgaaggaaatgattatcgttatgtttgtaaaatatgacaagcgcttcagaataaagaatgacacgaaaatacgtagaaagcagaagataggatcagagaacccatctatctctccaggtgttgaagagatggccttcctagaaatatcacagagacctgactaggaaatttgccttcacggtgtgtggagctggtcaactatgaagcagtgtctcaggcatattatactttaacacctttattgaggtacttacataccataaaattcactcaggttaccaccatccaatattgaagcattttcatcacccaaaaagatccctccggcccatttacaggcactccctgttttcctctccaccctagccaaccagtaatctactttctacctccgtagatttgcattttctagacatttcatatatacagaatcatacaatatgcaatcattgtgtctggcttctttcacttagcataacattttgaggttcatgcatgctgcagcctgattcagtacttccttcatttttattgcctaatagtattctattgtatgaaaacactacactttgtttacctatccatcagttgatagacatttgggtggtttccatttttgggccactgtgaatgatgctcctcatgaacactcctgtacaagtttctgtgtggacctatgttttcatttctcttgggtacatacgcagaagtggacttgctaggtcgtgtagtaagtttaactttttcagaaatagccaaactgtttttcaaagtggctgagttatttcatagacccaccggcaatgtatgagagttccagtttctgcatattcttaggtatatttttaaattcagatttacatgtattgtggaggaagcatcccctggataaaggtttgactttatcaagtctgtgaagtgcagagttcacatgatctcacaacttatgcacattccaagtttcacttaaatgtacttaaaaaattttgagagctgtccatttgaaaacatggttgaaataattcagtataaaaatgcgatactaaacaaccaagtaaatataatgatcatagaaattttaaccagaatatttgtcaaaggggagttattaaggaaccatgcaactcaaataaaaatgttccttgcaaactaaacaaaatctccacagggacaaaatcctgattgtgaatcctgcaaaccagcagcaacttatagaaggcagcagccacacggaggaaacaggaaagaaggacaggggattatttttttaaatctgatgcaacttgcattgtatcaagtgatgagatacaagagaccttgcttccagaaaagaaaagaaacagacctggcctcaaagggacagagaacttaatagtcacaggaatgtccctgctgctttgaatacccccaggtactctttgcaaacatacacactaattaaagggggttgggggactgaactggcaagagctttggttcagagatcacagagggacacccagccttcaaaccccttcaacagactctttcaatctagaaagcaaaccctgtatctggggctcggatctctgtatctctctaagatttattttaagtatcatacatatttcactgaatgtctacgatttcctctcttcatagagaggcttcctcctgaagaaggaccctttttgtttccagtgatgaggacctataataattatccactggcactttttctggtgcaatcagtgaaatggaggtttaggtacccagctggtcaggttccagcagatttcccatgctaattttcagtcactcaaagaaaacaaaggaaaaactaagattggtttaccatgattttaaagaaatactgttcctcttccctttccccctcccccaaaatgtgtaaacttctatatttcacacttttacatctgttcttctcccaaaataaaagctgtttatattcaagaaatgatggctacaataccagcacaagttacatctttaaaatactcccagagagaatatacatattgttcagacaacagagtgtctgtgcaatgttctttccctgaatagcatctgggtattggctctagaaagcactacagcgctttatttgtttatttgtttgcatggaaagaaaactgagtactctctaactggtgctggagctaccaatttaaagaagacagaagaagcagaggccttttaggaagagcaaatgcttagttttgactctgtcaaccattccagagtaagacaccagcaacagaaccacctggttccactgctacccagagtatccatgctctgaaagtcttggagctcaattgaaaaatcgcagcactcccaaactcaaagggccctttcaaccacgccaattgcaacatatattatctcaagcgttggaggaatcagataaacaggctgtgaaaaagccatttcaaatttgtagctttcttagacagagtctatgatttcaccaccactagaaaggaaactgctccaaacttagttccagacggaagttttcaaatgatgtcattcattgtcccatctagagcagttagtattcccgatttaaaggcttgaacagggcccagcacactggctcctacctgtaatcccagcacttttgggaggctgagcccaagagtttgagaccacgctgggcaacatagggagaccccccatctctacaaaaaaaaaaaatttcaaaaaattagctgggtgtggtagcacacacctgtagtcccagctcaagaggctgaagtgggaggatcacttgtacccagaagtttgaggctacagtgagccatgattgagccactgcactccagcctgggcaacagagcaagaccctgcctcaaaaaataaaataaaaataaaatgcttgaacaattccctgatactttaatgatattaacacctcttctgagaaaactggagctatccctctaagtgtcaatactgggaaaaacctaataatctttaaccaggtattttttatatctagtctgatgatgattgtctaaccatcggtttttccttcaaaatagttcttctatgaggggaggtcttcaaatttacatttttaaaagcattttccccagcaatgagtataaaattttcatgcacgctcactatcagttgtatataaagttgctttaacaaccatacttgccatcaacttttcctccatataaacagacatgcaatataagcaatgtgcttatctaagaactgtggattaaatagcaacatgggacacttttgtggctaggtaagagatgcttacaagttgttgttacaaagaaagtctgtgggatttcccagtaaggaaatcttcaacctgctgtctagattccaaatatacattccatttcccaggtctcaaaaaataaataactcgaagattttaggcttctaacagaagtagggctgaaagaatttgtgaatatggattctttctttcagtttccaagcaaatgtcagcacctcctggggcttcaaactcaatccctacaggcctatagggaaaaacaggaaatcgacatcagaaggatgcatcttgttgatcaagggagtggggcttttctgcaccttgaataaacttgctaaaaaaaaaaaaaaaaagaaaaagacatgtcaatgcaaagaacaatgcaaagtacagaattatcaattgaaagttgtagacttttcaatttcaagtatctttgagtcttacaaacaattcaaatgcaaatattagtaaaaaaattttaacttccatactcctaagaatgtgtactgtccacaatttctctgaggtcatatgccttatgaaaaagttgcacttaccataaataatttactatttcctattctgcaacattttcaggcatacccaaatttccatgaatatattttgcttttcttttttattttattttattttattgagatatggtctcgccatgttgcccaggctgatttcacactcctgggctcaagtgaagcttccaccttggcctcccaaagtgctgggattacaggcatgagccaccatgcccagccaaggaaactatcttttaaacatttaggccagtggttctcagactcccacatgcttctgaattactaggagggcttcttaacgcaaaagttgctggtccccatcctaagagtttctgattcaatagttgagcgagcccaggcatggtggctcacgcctgtaatcctagcactttgagaggctgaggcaggcagatcccttgagcttaggaatccgagatcacgtaggaaagcccttctctataaaaaatacaaaaatcagtcaggtatggtggcacatgcctgtagtacttgctaccccaggagctgagatgagagaatcacctgagaaccggaggtcgaagctgcagtgagctgagatcgcaccactggactccagcctgggtgacagagtgagaccctgtctccaaaaaaaaaaaaaaaaagttgagagaggcagggcctaacagaggatcctgaagctgctggtccaaggatcccactttgagaactgctgacttagggagttaaactgtcaactagcttttagaaaatcacaacatgcaggataacatttactgagaatctaccaactgcagaactctctactacctactgagtaagccgcacaggtccttgctccaaacaccatctaaattggcaacacagggtatacgtgcgaggggacaatacacagacacatatccaaaacagcaagaagtagttaatacagtcaaactaaagatgtttcatttctccagtgcatttctttatgatgtatcctacggtgcagttaaatctattactctcagatggacattactaaaccacaatgcgtagccattcttccttgcactatgccacttcatttcacttactaatggcagtttcatctgaagccagggcatgaaatgtagagagggacctcattttaaagcttatttatgttattcgtgttgtagcaactgtaaggatcagtgtgatgatcaacactcagatttcagtgataagttatcaagcagagtcatcgagtgcagatatgatctaattctgccatcaggctgaactgaaatgcacaaaaacagtccaacagaatctgaactctaactttcccatcattgtataggtttttaaagcatagctagcaccaactttcaaatgcatacttttctcatgaccctgtcctgagtttaagtgcatttgtatccagattataatcagagagggtatttaattagataatgtttgcaagtactttgaagatataaagtgctctataaatgctaaatattattattattgtttaaatacagtttgcaattactgcttacaacctgttccacccaccacactgctatcatttgattacaggcagctttaaaaaaaatacctagaggtagaaatgatgaaaccatattcatgtgaagccctggatttttaccctagacataaataatttataggcattttaaatggaggattaggttataaactgtagtaaatcaagaaaattgccctctgcaagaccaactaccataaagttgtgtcaattttaatagtttcttacttataaaccaggttgaaagtagattatagtccagaatacggagctttttactctggtggtttcctgttctatcttctattttctccattagaatcttaaaatatctacctatgtgaaaaactgaaagcacaacttaagattttgattttagcaattgtctggcagattaaggcttgagaatagtctctattctatcatggccgtagctcaccttgctatcttctatgatcatcacagagtcagctgtctccaattcttaaaaaactgaaacctttgagcctgattccacacatcctccaaacacacttgctggataattttccagaaagaatgacagtttaaatgtaaacaagccaagctcagtggctcacgccggtaatcccagcactttgggaagctgaggcgggcggatcacctgaggtcaggggtttgagaccagcctggccaacacagttaaaccttatctctactaaaaatacaaaaattagttgggcgtggtggcgagcgcctgtaatcccagctactcaggaggctgaggcgggagaatcgcctgaacccaggaggcagaggttgcagtgagcagagatcgccccactgcactccagcctgggtaacagagctagactccatctcaaacaaacaaataaataaataaataaacaaacaaacatcccctagatacactccacaagaatgtcactgttaatccccaaatagctaccatattaggtttttaaggttttaggcaagaaaaaaaaaaaaacacgttataatctgacattggtcatcttacaaaacaaagttacaaggaagaaataccttggaaatagctcttaaaacaccactatgctcatgaaagacaacttgtgccctaaaccaaaggcttctgggaagtctgtgagcctcagggtgataatacaacagataattctgatgtcatgacaaggtccataaatcaaatgatggctatgtgagtcactattggcagtggctttgggccagtcagtcgtaagctcagccacttagtagctctacgatctttggtaaactaattgatttttcagagtcttatgtgttcatttataaatgctacacacctacagcacaagaaattggaagccaatctggcaatatctagagccttagagatcattcatacactttcattctaaattcaatttctaaggagttatcctaaggaaacagagatgcacacaaagacttatatataaggatgtttattgaagcactatttatcagttggaaagttagaaataacctcaagcttcatcaacaggaactggttaaatatattatgatccatctccacaacaaaatgctaagcagtctaaaaacatgattagaaagttgagcactgactgaatattttattacacgttaaattttttaggcatgataatactattatggttatgtattttttaagtacacaaactactgaaatatttataaatgaaataatatgctactttaaaataatatgggggagaaggtgggtaggagtacagatgaaacaggattcattatgggggataattgttcagtagagagattattaacccttttatctactttttaataagagttttattgagctttaattcacattccataagacttactcttttgaagtgtacaagtgacttttagtatgtttcacagagttgtacaaacatctgcactatctaatttgggacgttagcagtcactccctgccagcaagcattagtctaccttctatctctatggatttgcttattccagacattttatataaatggaatcatacaaccatgtgtcttctcgtgtttggcttttttcacatagcataatgttcatccatgttgcagtgtgtatcagcacttccttttattgtagaataaatattccattgtaaggatatactatgctacattttgtttattcattcattggttgatggacacttgggttgtctcctatttgaggttactataaatattcatgtacacttttttttttttttttttgcatgaatacgtccttagttctcttgggcatatacttaggagtgaaattcctgggtcacatggtaactctgtatttagcattttgagaaactgtcaaactgttttccaaaatggctgtaccattttacattcctatcagtaatataggagcattccaatattctgtctacttattattattatactttgagttccgggatacatgtacagaacgtgcaggtttgttacataggtatacatgtgccatggtggtttgctgcacccatcaacccatcatatacattaggtatttctcctaatgctatccctcccctagccccccatttactgacaagccccggtgtgtgttattcccctccctgtgtacatatgttctcattgttcaactcccacttatgagtaagaacatacagtgtttggttttctgttcttgtgttagtttgctgagaatgatggtttccagcttcacccatgtccctgcaaaggacatgaactcatccttttttatggctgtgtagcattccatggtgtatatgtgccacattttctttatccagtctatcattgatgggcatttgggttggttccaagtctttgctattgtgaacagtgccataataaacatacatgtgcatgtgcctttacagtagaatgaattataatcctttgggtatatacccagtaatgggattgttgggtcaaatggtatttctggttctagatctttgaggaatcgccacaccgtcttccacaatggttgaactaatttacactcccaacagtgtaaaagcgttcctatttctccatgtcctccccagcatctgttgtttcctgtaatctgtctaccttttaagtttaaattccccatgaaaaagagttttaaaagttatgccatagaaaaagattaatagcatgagaaaaggctaattattaggtttaaaaaataggttacatataatatgtacaatattatctccactttaaaaaaaatctatttatccatgcataggaaaaaactactaagccatacaccaaagtgcatatgtggttatcattaggaatcataagtttaaataatttgagaattctttttattttttctccattttccaaattttctgcactgaccatgcagaaaccattgcaatgaccattgcttttacaatgagaaccagaaaagccttttaaaaattaaacaaaatttttgggaggccaaggagggtggatcacctgaggtcacaagttcgagaccagcctggccaacatggtgaaaccccgtctctactataagtataaaaattagccaggtgtagtggtgggcacctgtaatcccagctacttgggaggctgaggcaagagaattgcttgaacccaggagacggaggttgcagtcagccaacacggtgccactgcactccagcctgggtgatgaagtgagactccgtctcaaacataaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtaacctttattttcaacatctgaagcattgctacttatctatattgattaacttagctgagttctcctctaccatctaattagatttggtttcttcacagtggagcacaggctatcttcagtgtgttccgtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaagtaacttctctgaccccaaatttctacctacaaaagaggtaaattggatcaccaatcaccaagccctaggcagacagatagataagtagatatatagacaaagatatgcaaacacaatccccctttacttttcattttagccttaacatggttttatggctttatcctatttatgccttttatcagaaggtgccacaacttactttttggaggtatgaggtgtaataaataaataagatcccttttaaatgaatgaattaattgcattcacacaattgatatttattcaatcaacatttatcatgtgccagacacagttcaaagcaccaggaatgtggtgctgaacatgcaggcaagatccctattctcacaaaacttattaggctccagttgggacagccagatttttaaaaaattcagatagtcacgactgccttaaagataataaagcactgaattggacagtttcagggtggaagggagtgttactttacagatatattgcaaagaaagcctctctgtttagtagggagcctctaagagggccctcagtgacttctgccttctggtgttagttaatattcttgtgtagtccccttcgaaatgaatagggctgacttgggtagccaacagggtattgcagaaatgatggtgtgtgatttccaaggctaggtcataaaagacatagtggcttctgctctgctttcttgattcctctatctggtaaaagtgggcacgatgttatgaggatgctcaagcaaccaatggagccacctacgtggggaggaactgaggcctcctgccaacatccagcaccacataagtaaatcatcttggaaagagatcctccagctccagtcaagccttcagaagatagctcaccttgccaaaatcttcctgcaacctcaggagatacctcatgctaaaaccacccaggtaagccacttctgaattcctggcccacagaaactgtgagatataataaatggttattgttgtttaggccactaagcttgagggtagtctgctatgcagatacataagtaataatacaggcagcatctcaccttagacctaaataataagatggagccctccatgtgaaatttctgacacggagaactacaagaatgagcttggcatattcacaaaacagaaaaaaatcagtgtggctagagtgtagtaaaagacaagtgcaggctctcttctccatccaaccatgggtgtagaaaccatgccaatgttgtcttcagctcagccccagcaactagtagcacccaataatcaggtactgaatgaatatatacacaaacaaataaatgaatgaatgctggataccatgtgcatttcttcccctacagttaatcacatttcacagaatcacagaatactgggcctgaatttaccctgcacccaaacttgcaccttctaatacactaatcaaacaaatgtttgtaacatatgcaatgtattgttaaagtctacaaatttcctacttgatgcatactgccaaggttctaatttcactaactagagagacagcactttaaaatctagggttacttcagagtctaaatccgggtatccagcagcaacactgtaagggagtacccagcggaagtcacagtcagcccttcgtcctatcactcggtcttcaaaaactagaacaacactttaaattataaatcagaatctgacagctggaaaaaaatagctcatttaaaaattagaaagggatgttacgttcagtggcaattcccagctcattgaggtgcacagtttgcaatctcttggtatctccaacagatagaataagaatccatggctatttaaatgccctcagtcctgcctctagttcccttacatattccaggaatatgcatcccagcaatacaaattgctggaagtcacctccagcaatttctagtccaaaccactcatcttacatgtgacaaaactgaagcttagagggcaaggtgtcagagccagctttatgacgctgggctctaactcccagctgtgtgcctcattaaacctcaccatctcccaaactctctctacccgctcactgccagctctgtcaagataaaaactcaacgttgtcttccagtgggccaccccagaagcacaccctttcccgcccatctattactgtttaatcaaaacagcagtcataagtattatccgattgttgaaataattgaaacacactccaaacacacacacacacacacacacacacacacacacacacacacatacgccttgcaattctaacccatggtattttaaatctctcaaaacttagaataagacaatggagagaacactttccttggcagaaaaattctagaaataggaatacctacccaggaccaggcatagtatttctcgtaattggtgcccccggaattgtactctatgtaattagcatccactggaattgtactctacataaaaagtgtccccaggagtcatgcaacctagactataatgtaattcatgatccctgaaattgtgccatggtcagcaacaggccccacctttctgaggtttctatactctctctacatagcaccacctccagcccttctaaaagggttgcacagtatatattttgttaattcaaaatttatttgttgaacgaacgcctgctgtgtaaagaaaactggtgaggatccctaagaaaatcaaacgttgcctctaaaaaggaattgtctagtagtgaatataatccaagacagaaagttctgagtgttatgaaagaggtgtgaggtcagttctgagacagtctatgagtgggagggacaacttgagagaaatcagagacttctgtggaaaaggtggtctgcgaatgttcagcgttggggcagtaggtacagaaaggagactaagacagagcgccccctacagagcatccatgggggaatgaaattgttccctgccgcaatgggggagtggtcgtcaaaactgcagagctcggtgggaggcccctctgaattgccgctggtcttaacatgctaaagagtttagttttcagtctgtagactaaggagacagagaaggccttgaataaaaacaaccagattgaaactgtgcgtttggaagactcacgtggctacagtgtacgagaaaccagtcagaagaaggctggtggtagagacacaggaggaggggaggtcctgttgcgggtgttgcccaggggacagtaactacagcacttgcagggaacagtggagacaaggggacccatatgataaacattaagggaagaattttaagttggggtgatataaaatgtgttttgagaaactgagggcacccccatgagacaaccaggacatgtaaaaaagagtggatagaatcatgtttctctaaagggaaataagcttccaaccagactggaaggaatcacaagcggaattcatccaacattttctacttaagtcctccctctctctccactagagaccttatatttatatgtgcagaataacatttcattcaaaaaatatcattaagattttcttagaattctcagcacactgctaacaaaccagtttaggccctgttctcagagagctacttcccccacagaaatgtaagaatcaatttgacattaaagcatctttcagactcaagttactccagattctatcaggaagggaatcagagactggttgtgctcagctgggcatggcggccatgattcaatcacaggagcgcctggctgggtggactttagaaccactatcactgagagaaggaatggcgtcgaaacaagaagggcacggaagattaattccagggcagagacacagaaagaagaaaggccgaacgggcaagactcgaaattataagatatcaaagagttttacagataagggggaaaaaaggaatatttcctgaaagaaatgtactgggtactctctcatcaacaaaatattacatgacctcctaagtagataattatgcaaacagcaaaccatgacttacactggcttttgtactaaagattactccagttaataatgaataatgaaaatgattatgcatatttctctgatgttctgataaataccagcacaccctactttttatgaggcaatgccattgtaaagaaaacacctgtttagtatctctgaaaaataaaaagaatatctaatgaaaaaattgccatgctgttatcattttgagatactgttatcaactcatgcaactttactaaaatctcattttagaccaaatttaattaagtgctctggagtaatgaactaataatgtttcgagatttctttgagccccatgagacctctcaccagaaagttttaaatactgggccattagtgtatcattttatgtgtccactctatctcccaagggaaaagataaaactttaggaaggcacagtcatgatcaatgtgtttgtatttgaataatcggtaatacataaagagagaaaactttttttaaaaaagaaggttttaatgaacaatgctgatagttgatactagtttagaaatatgttaatctccaaaaaacttcagggctgcacttacctcatatgtaatgaatgcttaatactgggggcgcaaagctcaattcaggccatcaaagaaacatacaaggtcacattggtacacaaaaggaaaaaggcagctaaggtctgtggaggtactgttaaaaagagtcggaaccttctgatatctttttctgaagattattttccttcttttcttagtcttcttttttttttcttaaacaagatgtcactctgtcactgaggctggagtgccgtgacacaatcacagcctcgacttctcaggctcaaactatcttcccacctcagtctcccaattagctgggaccacaggcacacaccaccacactgactttttttttttttttttagagatggagtctccctacattgcccatgatgatctgaaactcctggtttcaagcagtcctcccacttcggcctcccgaagtgctgggattacaggtgtgagccactgtgcccaggaaagataattttctattagataaaatcattgcaatcaaatgttgatggtatcaattttcccactaaattctacttaaccatgggatagcatatttgtacagtgctgtatggtttttaaagcattgccttaaatactttattgattttgaaaccagtatgtgagaaaggcaaacagttgtgatgattcttattaactatggttaaatgtcctacccaaagtcacagagtgaataagaggtggacatagaactggggagacagggttcattccactccattcattcaagcattcattcacgtactcattcatccaactaatggagactatggctccaaagatgaacaagatctagcctctgccctcaagaagtccacggtttagtaaagaagcagaaaggaaatcacacaccaagtaaaacatgagcatgaaaagtgtagcaaagggatgtatgcaaggctttcagatgaggtcaattcttaaatctgggtttcaatggagaaaggaatggctagggaatgagggctaaggggaaagacaagtgtagatcatctaattttgttcaaatacaaaagtgtatgtgagtcctggcagaagctgagagtatgaggtcagcagcagccaactcctggccttgaatgccttaccctgtgggccaagttaaggacagccaaggtgcttaggtccagaaatatgctaatctccaaaaagctttctgggctgagctcgcctcatatgtaataaagcacactggtggcaactttcatctcttttaatactgagatgtcttgaagcaagaatgactcaagccccaggtttgaatgagtaaattgtttgctgtagcctatgtatgtatacacacattttcatacacccacgtggatacggtttatatccataatactacacataatatatgtatccacatagataatacaaaacatacacacaactctataaacctcacatgcagagccatctgaataacatgtatgtttatactgaccccttgagacatgctctgatggacacaggttactcagagaggttacctgtgcaggacaaccatgtgtcctaggtgatttcagacagtcgtttgcctgcagagtaggcattgaaccagggctggacaagatgaattccaaaggtggcctagagctccatggtttcatgtatcacaagcttacttgcatgaagtagtttcgccattctcaataaataaaattccctgaccctggtgaaattattcctttctgctattcttttgtactcaggcagaaaatgtattattgatttctgattccaccacagaaagtgtgacttagagaaaagagcactgaatgaggagtcaggaaatctagattatttcctcaaaccacgctcctcgctgtcccctccccttgttactgtgtgaccttgaacaacttacttcacgcctctgggcttcagtttcccaagtgttcaatgaaaggagtggctgagtgttctacaattctctttccagctctgaatctataaaacaattccagcccatccctcaagatttagtttatctctgagctctaaaaatcagggctaaaactggattcaaagtacctattttctaaccaaagaagatcctgcttcactcacttttaaaccatgcaaatcttgcataatttaaatgatcagtgctgtcattggttgctctggtttaaattatgcattgttgctatttggggaaaatttagactgggtccggtctggaatcactggctgagaacaataagcccccaaagtgagaaggataaaggcctctctagacaggatctgcttttaatgctttgagcccagggtttacaaaaagagcattgactgtgtacattaaagagccaccgaaacagcgagggactggtaagtctgcagcaaattctcccagaagccactgaccttggctgcatttcaggggtcaggcattccccaggaggggctcagcaggcagactttaccaagggcttaggaacaaatgagacatctcatctagatgaggccacctctccaaatgtggcaaggtggagatgatctgccctctgatttgtggagattacctatgtggcctttggacccactccagcagacacacctcacccacaagactggtcaaagaccctggccctccaggatataactgtctccacatctgcatctaagtcttctagccagcagttcctggtccccaagctagctgttgccctctctgtttccacacctcccagcaggcagaaaaacagaagcagagccctaagctgatagcccaggccacaaagagcaatttcagtgaattgtgcaaagatatattttcaaaatacagatcacaagaaagcacatcccaagtgtgaaccgcagtcgtccgcccagtgggccctcaccggttgctcccctgcctgcaggctccgtgcttggtatctcagaaaaccttcccgaggaaaaagcccataagggacaagtcccggcccaacttaaaatcacatcagactgctttccagtagaggagcaaggtcgagattccggcccagggaaatcaccgcaagccctgcgcattgttcagaccccttccccctttgccacttcccgccccccaccccgacctccgaccgattcgcagcaccccacccccagtcggggccatccatccacctgattaactcgccggcagcaactcccagcgtagaaagtagggcaaatgaacacacacagtcggtaaagcaggaagccacagacctggccaatgcacccaccctgttaccaaccccaccccgctgcgcagggggcagccggttcttgatgtggcatttccactccagggaaatagacagcttcctgtaataatgcatgaatgagctttggctgcccaactatcagaacagcccatttcaaacggcatctctgtttcttctcaactccttacttgccttgctgaaacctcatctcttagcccaacagattaagacgaagagagaaagacttattcaaagagatgtggaggaaaaggtttaattaaggagaccaaagagaaagtaccactttgatcacaaaggtagcactttaatatatcagtgcagatagcggcaatgtcagaagtactaggaatccaggtaaatggccccaagattcagcatcaatctaacaatgtattcctcaggagggcgtgtgaacttccatgcttcatccatcctggtgtctccctgtagagagccaccatgaattccttctcatccaccctccatacatcaagtatatgcactcgctttctttttaattttatttttggttcgggagaggaagaagcagtccttaaattggtgtccaatccttctcagacacccgctgctgccaccatccccacccctcacccccttccaggcaggcagcatctaattaaaatggcaagaaagctctgcccccttccccaaaggagtgtgttgggatcgggagttgggggtggggaagcgtcgaagcagcacttggattcctggtattctgatctcaaaacaacagcaaaatggattctatatcagtgatgtcttagtcaatacaatgaaacggcgtctgaggtaattcacgtgaaggtaaacgcaaaccagtggggctggggggagggaggtgctctacaaaggactggccacagacacggggaaaacacacacagacacacacacacacacactcgcacacactccagggagttccggtctgattgaggaaaagcagaaaacacatccctttcacctgcttaagttcagccataaaactgaaacgttacagccacaaagtcagaaagaacaggcagggctgagttaaagccataaataaaggtgagtggcagactggcatttaagggagcgctgagagggcgcccgggcgcgggaggtagaaaagggggagggggaggcagttgccatctacaagaccagcatagcaataactgcccccttggagcggcaggttcggcttcgcggggacagccagcctcacaatgtcatcttgcaggtagctggaaaacgtgaggggccagtgcctttattcacgctggcattctttttgcagaagggacagtcgggtctcgcgccttggcaccagacaactgcccggggcgtgtacacacacacacacacacacacacacacgcacacacgcctttcattttaatgctcttacaccggtataagatgaaactggcataagctctacgagccctcgggagagcctaagccacggccagaggaagacacgtaccgcacagcccctgccgtaggggctcagccaggagcacctcagcaaccccgaatcaaaacgggaatccaggttccctccccgacgcattctcccgctgctgtccccctgccccagccccagcccccagtccacgcaccgagcccattcaccctaacccaaaccactggaaagaaaccagaaaacgtcctgctcaccctcagagccgagagatctatttcatccaggcttcgagccggggagtcgctcgccatgtctacttcttcgctggagaaatggaccaaaaccaccccgaagcttttcccttggaaattccaccttggtctatttcactcgcgtcctcatgcgggtgtcgcgccagaggccccgggcccagcctcccccgcccaccccagccccacagcgccggatcccgatcctccgcgcgtcggtccgccgggtccgggagcccagcctgcgcggatctccaagccccgagcagcggtgcgtgtgggctgagcgccccgatcggctaagggcgctggggctgcgtgggtgtatttaaatgggacatgcttctttgcttgtgcgtggatggcggctgcattggctgttataat

SEQ ID NO: 311 - DNA, 58605 bp, Homo sapiens
agatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagaaggctccctggggccccgcaacgcccgcagccagccccccaagggcgcgtctgatttgccaggtgagcctccggccgagggcgcagcgcacacggccagctccgcgcaggcagactgcacagcccgccccaagggtcacgcccaccctgctaaggtgctaactttggacatctacttgagtaagactgagggggcacaagtggacgagccggtcgtgattactcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctcggggtatctgcattgtggaagaaacgtctggtcactgaactttcccctccatgctgaacttaagatagtgaagggccagtttacacagtcaagatttaagatgacacctgtggcagcctcctcagttaattccctttttaacacaagatttaagtttaacgaatgtaaaaataggatatccgttgaagctcaacgtttatgtagatgagagataagacctcatggcctgacatgagctgattctattctttattcaaaatgtacaagggtgttccaaggtgggatgttcttaaaatgcatgtgctgtgaatttcaaaatatggagcaaacagtaacatgttaaatacgatccagtagctttgacatgtgtgagttttaagagaatttgcagaaccttttatggcactcagtgcatttattggcaaaaagcttaaaaacacacaagaaaagttcctaatacaagtatcttggttgcttcttcccctttataatgttagggagtctggtgatacttttggacccaggctgaaaagtagttttcagttactgaaataaagatcagtgttcttactggaagattatttgctacatgaaagcagctgtgacaggtgtgagtttaagataattccaaaacattttatggaacttagtgcattattggcctaagcctttttcaaaaagtccctaatttatgtatcttggttgcttcttcctccttgtgctgcatgaaagcacaaaacaactgtgactacttgctgttaagtttattcatttcacaagtaatttatttaatactttctgtgcaagatattgtgctagtcactgtgggggaaaaaaaccctacaactgtgactcaggatattgccctgaaatttttatagccccatctggcacacaaaaagcacacaaatcaaataacaatacaagatgatatctgatgaaactgccaaacgaatgttaccatctgtaaatcctggggaagtgctagcgagcaagaaatcactgctggtgctttgggggagctgggccttgtgccttgatgataaatgcaatttgtataggtggacaggatagggaaggtactctatgaaactgataagaccctcccttctcacacttctgctccctcaccactcccacttagcacaggtgaataatgattaagtgcttaagtttttcctccattcacatatttgttcaaggagtgggtattttaacaacattatcattataattcttgaacctaatggtttctttcattctatttgatttcttggataagtaagcttaagaggaggagagttctgattgggagaactctgagaactctgagagggaagtatgcgtaatgaataacttgactacctcaccaactgccaacctggagacctttgatatagtcagtgatttattctgtgatggtaggtagcatcagagaaatgagctgggtgaatgatgcctattatttatagaagaccagtgtgattgaatgctaaagcctcctaaatgtgagccttagagaaacattgctgtgtaccttatgaaggatggttcacctgtcttccaattagaagacaccagtagaaaaaccagaaatgttacactgtgaaatagtaggctaaacaaacaggaaagatgatcttataatgaaattcttcgtttgctgttctctgtaatagaactaaaccaaatatgtctttcccagttctgattaatttatacctaaaaattttctttaccagacattcaatgtatttgttttgcgcagtgccttgcacatggtcatttggcaaattattgacttaaaaattaataagtatttctagtcctttgacccatttctttgtgactgatggttttttcagaccctttaattcttcctatgaccgtatcgcaagatgttaatcagattattctttaaaacaatttgagactgaagagtaagaaaaactatttcgtatttcctgaaaaatgacactgaagtagcatgttcctttatgctgttagaaaaattattacttcaagttctctaccaagtgctgaatgttgaaattcttaaaatggtatatgtagaataaggagaattttcctcttataatataactatggctttttggactccaaattattttcccctgtctcataatgaaggcattacaacatgaattataggagccttccttttaatcagtctgaagtaggttaattgtagtaactcttggtagcacaacttaatagcacagaaagtttggttgtaaaatttattctgatcttcgtgtaaatctttaatgtgcagatacgtgtttcctgtccttaaggtagcctgttggctaacctgtagtgttttctatttacatcataagatatacttcgatgtttgaattgagtacccttccttgaaatgattagtgagaatttttaaaaagtatattctctggtatgtgaccatccctcattaactgatagcaaattgaagctctctatttctaatcatctcactagtttcataatttgatctttgaggaaatgcttataaattaattttccttttaaatttaaggtatgggcctgcaataagggagcctaagtatcttatggagatattggggaaagcaatgcctgggagaaatttatgagcagagatcaaatttatttatttatttatttatttatttatttatttatttatttatttatttttgagacaggatctcactctgttacccaggctggagtgcagtggcatgatcatggctcactgcagtctcgacctcccccggctcaggtgatcctcccacctcagcctccctagtagcagggactacaggcgcaccaccatgtctggctaatttttgtatttttttagagacaggattttgccatgttccccgggctggtctcaaactcctgggttcaagtgatccacctgcctcggcctcccaaagtgctaggattacaggcatcagccactgatcccagcctcaaatttagtatcaagtaaaatttgtaaaaattaaaatctgaattctcagtgctgcttttggagagaatattttatccagaaggataagttgactcaccagcagtcatactgcctgtcccttctagaagctccttaggcccaagcttctttttttttttttagacagagtctcactctgtcgcccaggctggagtgtagtggcacaatcttggctcactgcaacctccacctcccaggtttaagcaattctcctgcctcagcctcccaagtagctgggattataggcctgtgccaccacacctggctaatttttgtatttttagtagagacagggtttcaccatgttggccaggctggtctggaactcctgacctgaagtgatccacccgctttggcctcccaaagtgtagggattacaagcatgagccaccacacccagccaggctcaagcttcatgaaggccaagtccatgaaggagaggcagtatgggatttcagtgtctccacttgtgtgttctcattatcaaagtggcctctaaagtctatgttatgttatggatctcatgataattcactgactttaaatgataaagatggaaagaaccagaggagctcattcaggcgggtatagtccaagcctatctggggaaccagaatagtatagtggttgggagcatggcatctgaagccagagcacctcacttcaaactgtggccctgtcacttatcagctgcataacctcagggagttacttctcaacacttcaacttcctcagccaaaaatagaatgtataaagtcgtatattaattaagtaagcccgatgaagcatttgtcaagggcttgacaatcactgattgttagtggttatgctttatctctcccgttttataaaccactggactaatggtttagactttttttttttttttttttttgagacagagtctcactttgtcacccaagctggagtgcagtggcatgaccatagctcactgcagccttgatcttctggactcaagtgatctcccacctctgcctttggaatagctgggactacaggcacgcaccacttcacctggctaatttttttgtttgttttgtagagactgggtctcagtatgttgcccaggctggtcttgaaccccttggctcaagcaatcctccctccttgacctcccaaagtactggaatatatatatacatatatatatacacacacacacacatatatatatacacatatatatatacacacacatatatatatacacatatatacacacacacatatacacacatatatatatatacacacacacatatatacacatatatatacacacacacatatatatacacacatatatatatacacacacacatatatatatacacacacacacacatatatatatatacacacacacatatatataagctttggaatcctttcttctaagaaagtttaaataggagcaataaataaaacagatactaggagtgattctgcttgaaaggagagtggacagccccatcctcatccctactttccccaactgcagcccttgaagagaaccccagggattccttcaaccataagttgggggaaataaaaacaactctgttctaaaccatctcattttttttaaagatgaagaagttagagtccagagaggtaaagtaacttgaccaggttcacacagataattagcataaaagccaggaccagagccagagaatgccaaacagagcacattttgtttctctgaaagaaagcactgtgtacattcaaagacttattatttccactgggggtaattatacccaagaaatgtgacggagagaggggagactctcttgcccaagaagtggtgacaaaaccaacagttgcataattgataagtaaatgacggtacatccatatgatggacttccatgcagcattaagacaacttttcaaacaaattttttggtaatctgaaaaatgttaactataaggttaagtcattttatttcttgaaaaagcaagatatcaaattatatgaacagaataatctcaattctattcaaaatatttaattatgcatataaaaagattagaaacatataaaaatgttaacagggatattgtctgactggtaggattatcagtgatttttaaatattatccaaagttgctatagtgaacacacttataatcagagaaaatcttatgggggaaggatgagatgaataaaatatccaaagcggtcaatagtagatgaatttttaaaatctatccttttgagataatatttaaaaagttatgctaaaataaaaatacataattgatgttggagcatgagaatgcattaaatatttaaatttcttctaatgttgttcaggccttaagatgtcttccaactctagtgccaagcactgtgcatacatgctacgtactcaataaattagttcatccctcatccctagagtttcttggctatataatcttccgatccctcatatgcaagcaaaacacccattaaaaatagttggtagtgtacttaggactatttaaaaatagtttcattaaaaaacaaatgtggcagagaatggtggctcatgcctgtaatcccagcacttggggaggccaagatgggaggattgcttgaagccaggagtttgagaccagcctgggtgacatagaccccattctacaaaaaaataaaaataaaaaaattagttgggtgtgtgatatgtgcctgtagtcccagctacctgggaggctgaagcaggaggattgcctgagcccaggagttcgaggctgcagcaatctatgatcacactgctgtactccagtcttggcgacagagcaagaccttgtcttaaaaacacatgtgtgcgcacacacacacacacatacacacacacacacaccacactccaaatgttatatatcagggagatgttggcttttcatagttttataattaattggtttgtgtgttcactttttaaaactaggtcaataactttatcttcctgctttttcctcacagccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatggtaagtagcaatgtgttattatttatttggggtatttttaaagcaagggaagagaaggatgatgagcaactcatgttattcttttagaaatggttaagcttatgtgctatagtttttattcattcatcacatatttgaaaacctgcaatgtacaagggaccgttagagtgcaagaaaaaaatgtactaagagtcttcactgaaggcatctgtagtcttgcagggagataaagctacaaatgctctaaggcacatgatctttttttttttttttttttttttttgagacagagtctcgctctgtcgcccaggctggagtgcagtggtgcaatctcagctcactgcaacctccacctcctgggttcaagcgattcttctgcctcggcttccctagtagcagggaatgcaggcgcgtgccaccacgcctggctaatttttgtatttttagtaaagactgaaaatacaaatacgggggttttaccatattggctgggctggtctcgaactcctgacctcgtgatccatctgcctcggcctcccagagtgttgcgattacaggtgtgagccatcctgactggctggcaataaatcttttaaggcacatgtgaatttatatgttgtattatgaaaggtataggtaagcttttagagttcagagacagatgagttgctttttcttacctattctatgtaaaaatgctcagtgctatacttagaattttgaagatttgtgaaggagcttcctctatttgggaagtccccagccagggaaactttttcttaatccttctctctgtgagattcactctttgttcccataagtagcaataggtgtttatcctatgcaattgagacagtattttgtctttattgggaattagttttcattagggaaatattttttttaccctgcaaagctgtggggaataaagaattttggttttcattggatcttttcttaaatattagagagaagacagcaaaacatgattttggggaataattttgatttctgcatcttcttttatctcacttcagaagatgtttactttactcggtttttgatgtgaattgcgcctttttgttaccaagcttatttaaggtgagaaaggactatgagagaggaaggtggaatatatgtttagtgatcagctctgccaggctagaaacctgagtagggtttgtattctggtggtccatcctgtgaacccggctgtctggcaagtgtggacctcaatccaacacagtttatctaggcagaaaataccttgcacctttcctcgtctgtacagggtactgcagcatggttcaatgtattgtattggcttttactacaatcctgtcagagaatgtgatgttgcaagctctttcaaaatatatggttgggtttccagcagaggtgcagatccctttttcatgtgatttcataaactttcataaagtttgggtttcagatgtttggtgttaggaccctttatgtttaaaaatgattgagaaccccaacgagcttttgtttgtatgggttctgcctatcagaatttattatattataaataattgctgagaaaattgtaaaacaccagaaagtagaagtgcacactgcaccagtgctcagagcaacgatgtcatcacacatcatggagccttgtactccgctggacatttgagacagagatgaaaaaggcaggtgacctcttcttattatgaaaatagttttgaccccatggactacctgaaagtatcttggagacccccgcagtggcctctgaaccacattttgagaaccactgctataaacaaataagactgaatcagcctatggtactcagaaatcataaaattctaactatttctattaatagttatataatagaaatattaactatttctctcaagcacaaaatttccactggtccacttcccattcattactactttgttctttttaattgttcttagatcgctttccttatttaactacagtctgacaaagttgataacagaatatacagtttccctatgaaaatcaagtcaaatgacataaaaaggaaaaataaaatctttatactttttctaggcctttttatgattaaaaaatatggtctttctttaggtcctgggcttttattgattgtatattcaatcatgaaggttttacctgaattttgttttaaattttaggctttttcttcagtttatctacttctaatgtgtatatatacataaataggtatataccatctggcttctgataaggctctaggggggcccttatggcctttttttttttttttagagtcagaatctcgctctgtcacccaagctggagtgcagtggcatgatctcagctcactgcaacctctctgccttccaggttcaagcgattttcatgtctcagcctcccaagtagctgggattataagtgagtgccaccacgcccagctaatttatgtatttttagtagagacggggttttgccatgttggccaggctggtctcgaactcctgacctcaggtgatctgcccacctcagcctcccaaagtgctgggattacaggtgtgaggcactgcgccccagccttttgtggtcttctgggcatatcacactctggtgtgatgcaagagcagtcagagcaaaggcagttcctaaaataggcatcctggtcagcactgaaagtagttcacgttttgtaatatttttacatgtataattactattttattatcttatgcatttctggttttactggtcttgtcagatggtcttgaaaatgattagttttggagccatattgaaatgtattttgtctatcaaaaaagcgggattaggccgggcacggtggctctcacctgtaatcccagcactttgggaggctgaggcaggcggatcacgaggtcaagagatcgagaccatcctagccaacatggtgaaaccccatctctactaaaagaaaaatacaaaaattagctgggcctggtggcacatgcctgtagtcccagctactcgggaggctgaggcaggagaatcacttgaacccaggcggaggttgcagtgagccaagatgatgccactgcactccagcctggtgacagagccagactccatctcaaaagaaaaaaaagggggattaaatatactatgtgcaatgtacattatgaaatataccatatataccataaacacttctatttagactagtggttgttatatgattgtagatttactatgagaaaacaatatttatatggattcagatagggtatgtatatgaacacaaaattgattcagctctttctaggtaagtgattaatatattctaatttatctttatttgagatgatactgatattatttgaattagaatctcttagctgagttcctattctgtgaactgacatgaaacatatgtgccctgaattttctagcattggtggaaatagcctagacatttaaattaggagaaattgaaatggcaaattcagttagaggtgaaaaaacctcaatttaaaagcataaactcaaagagttttaatacaactttagcatccattagagtggaggtttcaaaatcgatacaatgtgggaaaagtgtgatctacctacaggatcgtgggtggaaaaagaggatcgttatgtgaagttgtaattatttgttgtgtttttgttcatctgattgcagacacttagaggaagtgtccaaaataaactcaatccccgacctggaaaggtaagattattttctgtttctagtcttgattctattttggtctgacagagtacaacaaagtgtgctaccactttcgttttcttgcaggtagtgatatatagtgaacccgacgtctctgagaagtgcattgaagttttcagtgacattcaggattgcagttcttggagcctctctccagtgatactcataaaagttgttagaggatggtaagaatggcactttaagttcctgatgtcaagtgtttgagttttacatacttaattaactttttagtcctcactactagtttaaaattatggctttagcaatgaaaagcacaggaaatactactcgtggtaagataagggattcatatcttaacaatgtcattttaaatcatgtttctgattatagcagtgatatatgtttatgggagaaaaatcagaacaatacagtagaacaagcttctttttcccatgcttccccataatattgttttggactagtcatatatcagggcccataacatactcttggttgatgacctttaaatgaggttgataagaattgcactagttatgttgataggccagatacgacttttcaaaaacctataaggaaacttgagaacacgtaggaaaaggcaaagtaaagaaacaataaggaaaaaaaatctataaggtaaaacaaaaataatctataaagaaaggcatttttctaactttttaatgacagttcaatgcagcactaacttaaaatttaatttactttccaatatttccacaaaagattgttttggctaagtaaagaaactggtgaaaaaaataaatattttgacagtttctgaaatcattttatcagcttcattgcctcttggagatacacaggaagttgggtagagaaaggcagcttaaaaaaagaaatcgctgatctggcataatagttatcttttggtgcctacttgtaaacttgtttgaagtaaagagggtagacctctgaatgtttatggatttacaaattcataagcttttcttttggtctccatttgattaaatatgcagcagctttcctattagatttttaggtgttttaatattttttcctatatatccaacatagtcatgagaaaaacaagatttgcttttattcttaaatttgaagacaaatgctattttaattgctagagaattggccactaatatacaatatataatagtggcaattttttacacaaattttgtttttatggaacagtactttttcctttcttttgcaacttttgtcggcttctttttcttgaaagcataagcatttacactgccatatattgacatgaggtttttctttagtgtttggctgttgttgggaagaatattattaaaatgctttccattaccatatctatagtcttttgtgccaacatattcattgatatgactgtaatatgtaagttaaagtctctctaagagaaatgttttctacacatataaggagacaaaaggccagacatggtggctcatgcctgtaattccagcacgttgggaggccgaggtgggcagatcacttgaggccaggagttcgagatcagcaggccaacatggggaaactcagtctctactaaaaatacaaaaatcagccaggcttggtggcacattcctgtaatcccagctactagggcagctgaggcaggagaattgcttgaaccagggaggcggaggttgcagtgagccgagatcgcaccactgcactctagcctgggcaacagagcaagactctgtatccaaaaaaaaaaaaaaaaaagagacaaaaaaaaaaaaacctagtacagtaaacatccatttatctgacatattatcataagtctctaccacttggcaattacttagaacattagtagctctatagcattcatataggtaactccaaagttctctaagatcctgatatagttcatgagttatcagaggcttaattatacccagtaaaatattagtgttagggagagtttaagctattttaattgctagataattggctgctaatattctatatatatatataaaatggcaattagccaggttatttgagtaatcaaaacctctctcacgaagactgactaatggttttgctgtgttttattgttagttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggtaggttgtggtaaatatggattttatttattcagctaatatttatggattcttactttaagggaaatgatcattttacgaaatatgtgattgggaaacatatttggtgccttatggatatattttctgtattttaagtatttgtacactttaaataatttaaaaagaaacataattggttagataatttttcacaataaaccctttaggtagatcttttatgcctgtccttctattcccatcttccaaatatattttacctggtaacttggtttaaatgagttctgcctctatgaacaggtttttcatttatttagtgtttttgtttgctgtatgagttctgattactttgagtggtttataggaattctattttggaaaaataaataatccaaaaataatttggttgattaactctgggatttcatgtgggtttaacaaaatattatttactctatttgaggccactttatgggtgaggtaaaatttcttggtttcttgttatttgatgaggaaagtgttgtcagagtctttctttgtggctcttaggatttgatgattctttaccttaaaaatgcaattaatgatgtcttctaagtagaaaattaaaatcccaagttttaatggagacgagtgtcaagatgcaatacagagaaaaggaacattcttacatgagaatgagtaaggatgagtaacagttttggcagaggaaagcatcgcttacttcctgagtcaacatttctgagtaacttaggtggtaattggtatgctaaatgatttatcttttatttgttttaagtatataatacgagaagactaagtaagacttgagaaaccctatttcaaaatgtcctcattagtggaatattttgcctagagtttttatttactgctcaaataatattggaaataaagcaatgtttaaaaagatcatctgattcccaccatcatgaagtgtcccctccccttttattttttgaattttctaccctttgttggccatattctagtctgctttttctgcagtaataatcataatacaggtacaatgctgttccacccttctcacctaacactgtggttctcaatcctttttttctctttataccactttcctgaaaatcacactccccttggtaacatctttgtgattggcaactggggaaggtatcagaatctggtggggtgaggatttgggtgcattcaggaagatggggaagggaaacgagatctcttgttttgtctgataatagcagacttactgtagcaaatgcttttcatgttaccacaggtttagggtttagctgaatatcatattccattgaaatgatacattatttattgtttagtacataaatgaggtaccattatttatttattatttcttctttcagtgaatcttaaggttgtttctagttttttactattataagtaatgccacgagaatgtttttgtgcatttaataatttataattttcttttttttttttttgagacagtcttgctctgtcgcccaggctggagtgcagtggtgcaatctcagctcactgcaacttctgcctcccaggggttcaagtgatcctcctgcctcagcctccagagtagctgggattacaggcacatgccacaacacctggctaatttttgtgtttttagtagagacggggttttgccatattggccaggctgctctcgaacgcctgacctcaggtgatctgcccgcctaggcctcccaaagggctgagattacaggcatgagccactgtgcccggccagtaatttataattttctaatttgtttccttggggtacatttttctgaatggtgtcatgttaaagggctatgatatgtcatggctcccagtgtgtcatggattatattttcttcacagatcgtgtgcatggtttcttgaaacataaaacataagtcacagcgtatattttcaaggttacctttttagctcattagagttgttccttttgataatatttgaaaagcctcatctgagcttattcaagtgttaatatttcttctgtcactcagttcacccaactcagctgcatagatgagtttcaataaatattccattaacgcttaggcactggaccagaagaggccttttgaagactgtttggaccacagatatgcggggcatggaacaatgaccaaagtacagagatttgtaaatcactatgaatgtgtgcttttgcttttacgacttagatcaaaccaatatcatagaggtttactcagtcaaggagagttaccacaaagcaacagagggcttatggacacaaaacagtggctgaggaagactccaagagcagccattctacagactagagtctctgtgcttggataattatatcagagcaaaggaaccaaaaccccagaccaaagaggaccaagtgaggatgagaaaaagaaatatattccaaaactcaaataaaatacatttctgatgatctttgcttgaatgcaacactgagttatataactaaagcaagtgtgtctgccccgaaataggtgtattattaattcatggatgaaaacaggaaagggctaaaatggcaggtgctctgtgaaatgtgtttgtaaatttaaagctcattttgattagttgtaagaagaagaagaatgagcttactagagagtgaaatacatggtgcaattcttactatctatgcatctatattttttcaggattacagagttagtcacattgacttatttactgaaccagaagggttaggaatcctaagttcctactttgatgatactgaagaaatgcagggatttggtgtaatgcagaagacttgttccatgaaagtacattggggcacgtaagtatttttttttcaaacaaattttaatgaagtttttttgtgagtgtagtactggaaaaagaggacttaagatactctgactctaatttgtcatcctgttaagtaattattaactgtaaggtatatttttataaggcacgtaaaattctgattcttttgcacctatgttatgattcatctgtcttaaaaacagtatcgatttattataggaaatggggggggattgaattttttaatgtaaggctttccttgtcacagagaaatctgatttattcaaagctgagtagcagattatattttcatggtgattcagaggaggtaattcaaagcacatgcccctgatatttctggggggggatggaagccaacacacatggtacttccttgaatattttcacacaatgctggttcaaagcccctaggaggttggtttcacaaatcacaggaaacagcaagaatattttgaaggaaatgggaatacctcagataggggagaaatgaggatagaaagtatagactgcaatactgaagaatgtggtctccaaagtgaagcacaaagccccaaggcatgtgaaagacattcactgagatgcaggaaaaaacactaaagcttctttctatttgattaaagtctccacctcttaagattttatttttgtatatgttttctaatatgcataatgtattagttcagtggtaatgtatataatttataaatattcatatattcagagaatgctcaaatgtttttactaatggtttatacagtcaaaaaagtttacagcctgtccctaaagtggtatggagtatctctgcagtgaacaataaggcactccttaatcatgctttttgcattctatttattactaaaagccttggtttgccattgttcatatcttagaaaaataatttgcttgtgtaaaaggtaggaataggataaattacagatcatagaatctgatttttgatcctcagaaatgagaaactaaaaacttctaggcaacttaacaggaagtgtggctattgagaattggtagcagctatccttgaatagttggaaggtggtcatatagaagagatattagacttgctctctgttattccataggaggtcccaggaaaaaccagtagaaattagagagatggattttgacttgacccagggaagaactttctgatggttaatacagttaaaatggaagtgggctgccttgttaggtaaagagtttctcatcgcagggagtactcaggtagaggatggacaagaatttatccagagctttgtagggaaaggaaagtatgagttaggtacctcctttacgacagtttgttcatttatttatttacttttaacattttgaaatataagacacctagaaaaaagttcacagaaggtaaatgtacacttaaacaaataaagtgagcacccaagtagacaccacttgagccaagaactggaacattaccagcaccccagaagcccgatggtattctttccctatggcagcccgtctcagaaaacaaccttcctctcccagaagagtgagaaaataacaagggaggactatagtgatggttcgtcaatatacaaaggtgtagttactagggcagaatttggggtgtagagaacaatattaatttaaatatctcctcttgatgtataaagttattttccaaggatagtatacattttactgctttttaaattatttttaattgacacataataattgcacatatttatggggtacaatgtgaggttttgatacctgtatacattgcataatgatcaaatcagggaagttagcaaatccatcacctcaaacacgtattatttctttgtggtaagatcattcagaatcctctcttctagctattttgaaatataaaatatattattgttaatcatagttaccctactgtggaatagaacaccagaacttattctattatatatttttaccacattttctttattcattcatctgttgatggacactcaggctgattctgtatcttggctattacaaatagcactgcaagaaacatgcaagtgcgggtatcctttgacatacttgatttcatttcctttggatatatactcagtagtgagattgcaagatcacacaggagttctatttttaattttttgaggagcctctatactgttttccataatggctgtgctaatttatattcccaccaatagtgtggaagagttccctttgctccacatcctcaccaatacttgttatattgtgtctttttgataatagcctttctaactggagtgaggtggtatctcattgtggttttgatttgcatttccctgatcttgagtgatgttgaacattttttcatatacctcttggccatttgtatatcttctttaaataaatgtactgttttttgtgtacattttgagttatatcatttggtaccccgtagtccttgaaaggctctgaaatttttaaaggtggttagtttagaagtagaaattaggaaaggcttttatttcctctgcataccctgtctaaatatgacaagaaattgggactttaacaaatataaacccaaaagagtgtctatgagatgtattaaatatattcagtaaatctgttaatcaagcatctaccatgtgccaggtgcttttctagtcactgggaatacagcagtgaagacataaaatgatgtccccattctcctggagctgtcagtctagcaggaataaacaacacaaatacatatataatgtgtcagatggcaaaggctacaagaaacataaattacagaggggcaggcatgttgctattttagatagggtagctagtaaaggactctggtgacattttaaggagggaccggcaggaagtgagggagtctgccctggagctagctgagggaagaggggcagggagcctgtcccagagaggaagcacaccatttgcaaaagcccttctgggcatgcttgggcaatagctaagaggccaaggcggctgaagctgagtgaagtaggaggatagggataagacagggctcaggtcacatctggcctttcacgccttggggaggaggatttagatttactctacgtggcatggagaatcattggcgaatttttatctaacttgtgttattaatagaaggatcagcctgtctgttcgtatagaaaatagtctgtaaagaggcaaaggtggaagccaagaaaccacgtaggatgcacttgcaatcatacagccaagaagagatggtggcttagacgtgcgatggtggtggtgggaaatggtcagatcttggatgcattttgaaggtagaactaacagcatttctgacagattgtgtgtggggtatgaggggccaagacatgcccagggtttggaaccccaacatttattgagacgaaaaagacttggaggagcaggataggagagagagtgagattcaggagctcagttttggacaggttaaggctgagatgccaactgcaaattcaagtaagtgggcaagaaggtgactatgtgaggctggagttcaggggagaggctggaggcataaatttaggagtcactggcaaagagaatgtatttaaaccaggcacaggacacagtcccaaaggggagtgggtgtagttaagggaagagaaggcacttttgtatttagagactgggaagaaaagtgggaatctaagcaaaagaaaatgccttcatctcttgctgcctttaatttttttacatgaaagaagtctatacacttttttttaaagaattggtgtcaggttgagaaacaccactttccttagaaaagaatgaaaaaggcatctgttatcatattttaatctcagtgtctggaaggtgccatgactcaggcttggctatgttgaagcacattaatctaccttaaatgatatttcttacctttgcagtaagtttagctttgcctcctgggtggtagttaccagcctgtcacagcttacaatttatgacaggtttgtgtcatggtgagcatcttcttttctggctgttcatttctgttgaacactgcctcagatgttaattcaaagtttgggctcgttgaacttggttggtgagcttagacaccaggtcattagtgcttttatagatctcaaaggaaagtctcaaggggttgagaagatgtcactgatagtaagtactgaagctcattttgcttctgttgatgcactggttcccctgaactgggataagaagtctttgctgtagagggaactccttaagaatccattaggtgatttattccagggcccattcactctagattaagctcttctactcatacacaaaataagggtgttacttgtctggtcaaattcttgtttgaggaaatgagtgatttctaactaaacttgcctttcagattctgttgagagtaatttgtttttaaatctttcttttaagcagctggctaatcctggcacccatcctcccagaggtgaaagcatattgggttttttgggggcggggtgtgtgtaggggtggaagtggggggtggtatatttatgacgaacaaaagcaaagaagtttagaacttcaaagggagtataaagatgatctggcccaacaccatcatttgactgaggaagacaagctttggtcactttctccagactagggttagctgttagcagaatgtgtactagaatgcaggtgttctaaagtcaagggacttcttttttaattgacaaacattatttgatcatttgtactgtgtaatatttgacatatacagaataatatatgtatatatgtgaactatgaagcccaataataaaacaatcccccgtggacccaccatccaacttacaacctagaccattaccaacattgctgcccaccgtggttacacatgtaaccacactcctaagattactcatattgatgggtacatctctatgtatttttttcattgctgtgtaatagtcactgtatatttcattgtggaatataccatatcagagcccaattttttattataaaagttttcaaacatacagaaaagtaggaagaatagttcagtgaacaccaatgtaccattcactttgacccaataattgttatcattttaccatatttgtgttatttttctgagcacttcaatgtacattggagatatcatgacccttcattccacataggattcagcctgactctctttctaatggtattcccctgcataagtatcattattacacttgagaaaattcacaaagtgtccatgataatatctgttcaatagtccatcaccaaattttcccaattgcttcaggaatgtctcttatagatttgcattttcaaatcaggatccaatcaaggttcacataaatgcgtttgattgttctgtctcttttaagtctctttttaaagatctctaaaataccccatctttgtttcccaagccactaacttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactaacttttaaaaagatttaggccagctgtcttagagagtgtgccacattctagatttgtctgagtgttccctcatgctactatttagcatgttcttctgttgcccgaatttcctatctactagggcttaggtcttaaggtatggttaggttcaggccaaacagttttggcacggatacttcatatagatagtgccatatatttatgttgtatcacagcaggtggcatgtgctaactagcttgccctttagcaataccaagtttgattgcttggttaaagtggtgcctcctccatctttccattgtaaaggttcattttcccctttgacattcatagccccctctcttgtgaataacctcaaagtcagtaccttcatatttaatttttcaagtatccagttggtttctgtgaatggccaatattcatgtacagccatgtctagggaacacaacttaagatccatctggaagtgctgtttttgtttaagagcaagtgaacaagataagactgatttttcttgtgtgactcaaagggtatttctaaaagagtaattggacaaatattttaaataaacatatagatggccattgttattactttaacaatattcatttgtaggtatacatttgtttgtttaaaaaataagcttgggctttataatcatactgtttgttaagtacgacaataaagttgtactttttaatctatattggcgaaagcttatgacccaagtacatgggaaaataaaagattacctttagaaactgaaataaccctgcctggagatagtttccccctctcctgatggcctcataaataatgtatcttattggaacagaatttagaaaaagtgaatcatactctgcatatgagttttcaaattcaaagtccacccagcattaataaatgtctgtttgaattacccagcaggccttcagcactcatttactaagggagaactttcagaacagcagtcttttcaaatgcattcattcatgttttcggttttttcacaaattcccctctacccagaatgactttccttccatgaatgttatgcaactaaaccacatgcttcaacagaagtgaaatgtttagtattagatgaataaatcccctctgaactcaagctatagaaggaaagacttaatgaaaagggtacttcggtaagaatcatttcaaaatctcagatcgcttgctcgtgagccgtacattcagtttttgaaaaattaaacctgttcacttgtaaagaagtcagacttgggacctgcttggttagcctaataccataatgtgttacagaactgccattattttgttagagaacaaaatccatgggtactgtgcctgtgatagctttgagctccaaaatacatgtaacgtatccttggctgtcatgctttaaacataaggaagtgtaaagtaccctattcttagcgtctgttttcttgtggtttagaagcattacagtagtatttaaaagataagcctctttttttccttaaggtaactttttttgaagcataacatttgtacaaaaaggtacataaaccctaaatatataagctgagtgaattttcacaaagtgaatacacaagcgcagtcaccattcagatcaagaaaaagaacattcccagcatcgcagaaacccgtttctttcatgcgtcctcacgccctcttccccaggaaccatcatcctgacttctaacactgtagttctgacctcctacccatatcccacacctggcctcccaacattctttcatgtgtgtgttgtcaaatcatcagtaggagcctggttgtaaatctctgtataattagagagtctagagaagttaccagtttatccagcggaatcttcacaaaaaccaccgccaaaaatgtgccttgggccaaaattgggaagaagaaaaaagcaaagagggaggggtcagacccgttttgttggtaaaagatttcatttacagccactctcttcttggcatggtgttctggggaacacaacatggtggagtaccacggctaaaacattttagcaaaactaaccgaattgatgagtgtaagtgatcactaagaagtctatgtttgtttatgaagcaggtacattaacccctctcttatagaaaagtcacttcttcagcatcctcaccttctcagaacccttcccaggaacgaagatgtttacaagaagaccttgtaaagtttagagacagggctagtaggcatggttttctggtttcctgatttctggcacattagaggagggtggggctgctggttccccaactgaagcagaagtgacagctgacaagctgatagaagggtgtggtattgaaaagccataacaatcagaaccaagaactcaaaaagctttgtggcctgggaacaagcagccccacagaacttcagagcccctgaggacaccactgtgcattaaataatgctcacagtgatgatcctgagtaactgtgaaaagagtaaactgtgttcaatgcacttcctgcaatgagaaaaattgccatcacaaaaatgattagggctgggcatggtggctcacacctgtaatcccagcacctttgggaggccaaggcgggcggatcacctgaggccaggagtttgagaccagcctggccaatatggtgagaccccctctactaaaaaaaaaatgcaaaacttagtcggatgtggtggtgtgtgcctgtactcccagctacttggaaggctgaggcagtagaatcacttgaaccaggaggcagaggttgcagtgagctgagagcaagccactgtactccagcctgggtgacagaacaagactccgtcaaaaaaaaaaaaaattgattaggaacctggttctggaatcggcttgaatcattccagcctttcatacttatagctgtgtggccttgggcaacttacttaactttatctataaaatggggacaatagcttctcttcctcatagcatggttgtgaggattagatgaagttctcagtggcattccttgtaagctctagggagatgttagctgttactaatgtttggcaccatgacaaatgattagatggaactttggagcaattaataatacaaattaaaataaggggacaaagccagccaaggagaaaagtaaaagatcaagaataggggcatataatggctttatttttccttgagtctagtgtgattctaacacctgagtccaaccattcattatgtaggtccgtatcctctcctgttcttttcctctcatcctgggtaccagacagaaggaaaaactgaaacaaatgatgagtcggctccctttctttccttccatggtggctatttaggtggctgatttatgaagaacctggatttcagggtgttcctttcatcctggaacctggtgaataccctgacttgtccttctgggatacagaagaagcgtacattggatccatgcggcctctgaaaatggtaaaaatgaaatccaaatgtccttgtggtgattctttgtcagcttgacgtggtaattcacagggtgtgactttgaagcaataaagctgacttttaagaaacaaatttgtagtagattggacctattgctcaatagaaatcatggaaagaataacttgctagatgctatagattaaaaaaaaaaaaaaaaaggcaggtaagactatgtcctttgtctttaaggcattctcagccctgcagagctgcagatgggtgcgcaaagcttcagcgcagtgtaggtttaacaagtgaggaaagtgaagaattaaacattggtggaaaaacaggacaaagatacatacaattccaagttgtgggtgatgtgacagaaaagggataattaggaaagcttcatgctaaattaaattcagtcttaaaaaattagcaggatgattttttaaatggagctgtcggtgaatgcactgtgtgagctagggtgcagcctgagagagagcagggcacgctgaggaccggctcggctgccgtgacacgagtgggtggtgtcttgggggtctctggggctggaccagatgagtgttgtcctcctgagtatctgctgtggaagctttgtgcttcctctcccttgtcccagtgtcttgctttgttctttgtttcttccgctagactgtcagctttgggaggaagcaggccgcatctgtcttgtccccagtgttgagcgcagtgtgtgctgcagcatggaagttgttccctaaatacccacagtgagatgaggctcccattacaaacatgtttttgaagctgcacttcgcagttgtcttctgagacagtttgagacaaattagaaagttaggaagacaatttttttaatgttaattttacccatccttccaaagtatttggtttaattatctgtatgtttgctggtcttaatgcaaatgatttgggcttttgtttctaaaattaaactcactttcaaagaacaaagttttgttagttttgtgaatgtatgaaagaattcatccaggttttaggagcagtttgtaatgatgatgaaaagtctccaaagtctatggtgttcaaacaggattacttttgaaaaggtcatgtgcttagttgtataatctctggtttgctgataatatcagccacattcctttttcctttttttttttgcttgttttttcataaaagttaaggaaaccaacacattcttttataattatagttcatttggtgcctttgagcatccttggtggtacttttttttaaaaagctattaaagatatattaattttaaaaaaatccaactttcccattgctgatttaaactcttgaactatttaatatttttgtgcaatatctttttaatgtaataccatttctctgattttagtgagtttttttgtttttaaaaagctttctattttataacaacccctcatagactcatcctttgggatgttttaaattttatttaacagtttatctaattattccatgagtcccccagatcttattatgtgaacttcaacacataatagtttcgtaagccctggttgcaaaatcaaataccttcaggggccaggcagcaaatacaaatggctgagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaagtatggatttttatgataaattttccaagttaaaaaaacttgctaggtcaaaaaacactcctacaacgcagatcagcttatagactgcttgtgcgaggctccgttctagcctgccttcctcgtgtcttcatctgtattgttggtaattttagaactatctcacgtaagttaaaacaaaccagaacatagtcacactgaaattcaatgttttactgtaaactgctatggctaatataaaatggtaatgtatcagtgaaaaactatttttcttactatgttgtttttttcagggtggccgtaaagttgaattccctacagatccaaaggtaaaaatatatatgtatttttgtatgtatgtatatgtaattatttaaacatatacacatatatatgtacttaatgttattcccactccatctctatgaagatattgcttatgtgacttctcatattaaacctctgtcacacataaatgcagccaaaggaagttgccaacttacacttgccatccttcagggtggaagatgatgctaatggcactggttatcactaagagtacatttagccatggctcagaagggtcattgttatattgagttaacaatttgcagttgtatttactaattgcagggcttcttgctgcttgccaattagccaggaaaaaacttttttaagacaaactttccctactccaaaataccctttctgctattcccaattcccacatcgatgccacacactataacttttcaattttcaattttaacactactttagaatcctctggttccttctatgtggttctaaatatcagttttatatatacatatatatgtgtgtgtgtatatatttattttatatatatatgtatataaattattttaaaactgtttggaaccatggctttgggctataccacattagggaaaaaaaaaagccagatttttttttttctttttactatcttatcagatgccattatttagggttttttttttttttgtggagaccaggccttgctctgtcacccaggctggtatacagtggcaccatcacggctcactgaagcctcgatttctccagctcaagccatcctcttgcctcagcctcctgaatagctgggactataggcatgtaccactacacccaactttttttctttttagcagagatgaggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttattttattttattttattttattttattttattttgagacaagagtttcactctgtcacccaggttggagtgcagtgacgtgatctcagctcacttaaccctctgcctcctgagttcaagcggttctgcctcagcctcctgcgtagctgagattacaggtgtgcatcactatgcccagctaatttttgtatttttagcagagatggggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttatttattttaattaaatttaattttattttattttatttattttattgagacaagagtttcactctgtcacccaggctggagtgcagtgacgtgatctcggctcacttaaccctctgcctcctgagttcaagcggttctgcctcagcctcctgtgtagctgagattacaggtgtgcatcactatgcccagctaatttttgtatttttagcagagacggggtttcaccatattggccaggctggtctcgaactcctgacctcaagtgatccacctacctcagcctcgcaaagtgctgggataacaggcgtgagccaccgcgcccagtcagaaaattttaatttgtgtgtcaggacttagtgatattaaatgactgatttaatgttaagctgttgggatacttcttacagattactggtatatctcatttctattgtaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatgtaagtacatgggtgacttgttaggatttcttttttttccgaaatattaagtaataaatgtgccctttcccccctaaaaacaacattcctgattctatagtatggtgaattttgacagttatatccacattctcctcagcctatagtgactggatttaagaaagcagtttgaggctgggtgtggtggctcacacctgtaatcccaacactttgggaggccaaggcgggcggatcacctgaggtcaggagttcaagaccagcctgaccaacatggggaaaccccatgtctactaaaaaatacaaaattagctgagcgtggtgtcacatgcctgtgatcccagctacttgggaggctgaggcaggagaatcgcttgaactcaggaggcaaaggctgcggtgagccaagatcgcaccattgcactccagcctgggcaacaagagcgaaactctgtcaaggaaggctgatacattggcctgttcaagttgatcaaatctacaaccttgcttattagaattatgctccaagctattgaacagtttgatagttcgctttctgatttttatatttttgcatcttatagatcttgcacatttcccatagaagtgcacactaaagttgctcttgtaaatcgctaactattcataatatttttgttactatctgaagtgagtttatccagttttgcttgctgaggttcttttgagtcagccctgattaaacacacacacatacacaccactcacacacacgctccccttcccttttttatacaactctgatatatgtctcttaggttattttcttggggccattctgttattctcctaaattttaaagaattccaatgataataaagcagaaggtcatgtctagctttataactatttgtatttttcaatgaaattgatatgtaccttgaaaaaatgttaacatgtctggaaatgactactcctcgtgttctttatgttgcagttgggttgcatatgagaaacctggatttaccggtcatcagtatttgctagaagaaggagaatacagggactggaaagcctggggaggttacaatggagagcttcagtctttacgacctatattaggtgtaagtaaaggacaagctaatggctaatacttggtcttctttggataataaatggctagcctttgaattttgaattttttttctcaataggatttttcaaatgctcacatgataatgtacagtgaaaaaaactttggatccaaaggttccagtattgatgtattgggaattgttgctaatttaaaggagactggatatggagtgaagacacagtctattaatgtactgagtggagtgtaagtgaaataatccagttggaattttaaacatgcgttttaccttggtttgttttaaactggtaagagtctatcacagagtaggcattcaatacacaaatatctcaacagcttaacattaaatcagtcatttaatagttgctgtcatgatattttcgttaactctctttaaaaatcgttctcataccatctcttctttttacgtttggggtaggctttgggtatcatgatagaaatctacagatctgtttcccttgtcattctgcacagaaagatagtgaattttttaaatgatggagatcaaataataataatagtaatctaacataaacctgaggctgggtcaaagtcccagtagattttcctgtggtcctacacctgttccagtatatttcttcactattagtttgacataaaaataattgttctatgtacgtggagttagcagttgactgttttattagtggtgaagcaagtttttattgaaagatgtttagtcaagattctttgggatgaagtgactgcaagccaagctaaattggctcaagggattaaaatggaacttactggcttaagtaactaaaaagtcctggagaagattttgcttcaggcatgcctagatgcagcggatcaaacactatcagaacttagtctctgtgtcttgactgggcttttttctgtgttaacttgactttaggtaggccttttgcatttggtggcctgtggccacattcagcttttgttctcctaactctttttttttgaggcagagtttcactctgccacccaggctggagtgcagtggcaaaatctcagctcactgcaacctctgcctcctgggcttaagcgatcctcctgcttcagcctcccaagtagttgggaccacagatgtgtgccaccaggcctggctaatttttgtatttttttttagagacaggtttttgccatgttgcccaggctggtctcaaactcctgagctcaggtgatccacccgccttggcctcccaaagtgctgggattacaggcatgagccaccatgcctggccccagctcatttcttgcagtggaaagagcttctctttctcacaagttccatgtttgactttgctttcctaggcttgggtcatgtgcacatgcctgaaccaatcactgtagccacagagacggccatgtctgggctacgtgtccatctccagagctgagatgtagggtctatcccataggagccacttagatatgaatggggttggtggttccccagggacatcagaaagagtggggagatagatgccagatgggcaaaaacagcagatggctgttatagggagttacataattattcttgtaatccaggctaatgtctattctaatttgttataagtgagagtattctcaaatagttacatgaaataatgtgacattggttatgctgaaagtgtttggtgttaggtttttgttgtcatagtgacatagactatttgaatcatcctagcctcaaccccattgtatctcatggggcctcccacaatagccctggatatttgaaaagtgtgtacaatgtactaaaagttgatgaacatgcttaacttttactcttagtaaatagagtaaaaaaaaccttgttcaacaagttcttgtctaggccgttgcatgtggtgccattttggcagagtatcagtgatttccgggtattccattctcagcaggaaatgcctactcttgggtcctattctggagccctaacattttagaatcagtagcctgtttgcaaaagccagaagtcatctgaaatataaggtacaagttatctgaaatgttgctggggctctgcagtattttagattgtctttaaagctaattatttaggaggaaaacatagtgaccaacttagtctggtgaaacagttgtacattttgatactcaccagttgtgttggttctattagtcagagcctagtcatccaccctggcagaggaagcaaaaggatgctgggtagaatgaattcccttaggtattttgtagatgatgctattaacacaggtagaattattgtgccttgagccaatctcctttcctttttaacccaggccttgcttacttgaaatcagttccctttataaagtgctgctattatatgtttctatttttagtcatttctaattgcatttcctggcttaagcttcttttttctggctgtagcagttaagttttggtagaagggggaagttgaagggagctacgtacacatacgtggacacacacacacacacacacacacaccacttcctttgaaattctttgcatatggaagggcttttgtatttaccagggccaggtgcttcctcatattttgttcgatttgtcatttgacaagtatttattgcggtctgttatgtgcaaagcattgtattatgtcctcaaagaagttacggtatttatgtaaaacataattattgctacaaaagaggtacagattaaatgctctgggaatccacagcagagagagattaatttccagtctggacacagggaaggaagactttgtggaggaggtggcattggagttaggcctgtgggataggataggaaggctgagatgagccaagatgatggaggaggactacctattcactttaaatagtttcaaaggaaaattattgtattttaatggctttatttttattggcaattaagtattttagcttggttctttatttcttattatggcatgcattgtcagaaaaaaactcttctgaagttcttgttccatgaaagtatctcccaggaggctcaccatcacatgggtaatacatcccctgggcagtaaactcatcattagtcctgaaacagagaacagccttcaggaaggatgcccatgaaaccagcaactgaggtttttaggaactgcatttgattcttactggaaatgtcgaaagaaactccctgcttatcagtttctagttctatgctatattcttgctcaaatagtggaaactgggctagttttttaaaactaggagcaaaatgaaatatttctggtattcagatgaaaacgaaaagtgttgttgttttaaattctttttcctttggccttccacggaagggcaggtttaccctgctgcccttatcttctgagcaattattccaccaggctgggacctgctagtacttgtgtacatgcctttcccccgtctccccaccagtctttaaacagaggagtgttgattcatgtgtacagaatacatctggacaaggacagggagggattttcttaagagccccaagtgtaagttgtaagtagactctcggatcatagagcagagaatctcagatctgggttttgcggcttctcccctcccccactccccccattcatgggtgattcatcaggtatcttggagggaaaacaacactactgtcagttcaagtaacatcttaataaattgttttccagcttcagcttcagtgaattagagataggcttagctgggtgttgggtatttacttacaagtagtttagtttcataggaaaatacagtacccatacttgttagtaaaaagaacagagtactggctaaagctgcttccagggctgtcctctctccttggcattcagcctcccacctcactgtcttttttccctccaaaccttgaagtcaaacagaaaggcctttaaccctcttatctctctacttgttacagactcggagccctggtgagaaccctttttttgatgtggctctacttctttaattgttcgttgtttttttaaagtcctagtgtttgtaacgtagattttctttttttttaaattttattattattatactttaagttttagggtacatgtgcacaacgtgcaggttagttacatatgtatacatgtgccatgttggtgtgctgcacccattaactcgtcatctagcattaggtatatctcctaatgctatccctcccccctccccccaccccacaacagtccccggtgtgtgatgttccccttcctgtgtccatgtgttctcattgttcaattcccacctatgagtgagaacatgcggtgtttggttttttgtccttgcgatcgtttgctgagaatgatggtttccagtttcatccatgtccctacaaaggacatgaactcatcattttttatggctgcatagtattccatggtgtatatgtgccacattttcttaatccagtcatgtagattttcttgatgtgcagacactcctcccacatagcagtgctccctgctctggctttactgttgcttcctttcatgctgggggtaaagcctgaggccctgtgggcagaggcagcacatgcgggtacccgtgtgctgtacagcatcacctggtcagcccggggaccttggcccactctcctacttacacttgaaaatacaaactttcacaaaggttaagtgagttcttcaaagttatctgaaagttaatgtcatggccacaggtggagccaggtctcctatctcctcacctctcagtgataaaggataggtttttaggccgggaacagtgctcacgcctgtaatcctagcactttaggaggctgaggtgggtggatcacttgaagtcaggagtttgagaccagcctggccaacatggtaaaatcctgactctactaaaaaaaataaaaaataaataaaaataaaaaagaacaggttttaaaaattgctagtgaggttctgaaatcgggggatggggggtggtagggggctgtatttcctgaaagactgagtggtgcatatagcagcttctccatttggatggctgggagtgagtgcacagatgttggctgttattagctacttctcactggagattttggcagtgttctttttttccttgatggctgttcatattctagtaattactgtacttgagtttttgtttaaatcagccctttggatagtaaaatcataatctgctctaattataaagtgtgtggactgttttaggcatggtttactagaacagtaaatgaaagggaactttccagggcacatggcaggttgggtcacaaagcaaggagagcctggtgggcctcaggacaggtaggttcagtcacgttctggccaatagtcgattgtgtcaccctggacaagtcatttcccattcaaaacaaataccaacaaatacttccatgtgatgctgcttacccatctgtgggctttggaggacagagattttgtctttttcatctttgtatatctagtgccagtctagttcctggcacctggtaaatgaattaacttactgtgtcttaggtttttcccatctgtaaaatgggaacaccaatacctccctaggagattaaatgtgataacagatgtggaaacattttgcaaagttctgatcaccctacataatacatacatagatattattcctttaagctttgagaggatcatgagaatgatgaattaattgaaaagatacttaatgtcttcaatataatggtattaagtatctctttaatataacagaactgaaaaaccttttcctttcaaagactttatctttgcataggaaatagcatcattaaattggttttgttgattttcctctgggtgtagatcacttaaaagagaaaaaaacattccaaaagagatttatttttagtatttctatgagtttgctcaattttgtttatttaatttttacatatttatgtgatgttggaaacactgttggaaacaatattttagttctgttctgcatttttaaaagcatttcttctgttaacttctttttcagtgtggtttgttgtgtaatagacacagcttcctaagatctttctgcaaaaatattttaaggttgagaatgaaaggacttattgattgcttattaaaagaactaggttcttcttgaaagtcctgtttgttttgtttccttagaatacaattagaaaaaaaaaagcacagagaagtattgcctttgtagctttctcaagaaatagtatttgataagcgagaacgccaaaaagttcatgtcaagatacccttacgcttaccatttcttttgcattaagttttttttcaactcttattttagattcagggggtacatgtgcaggtttgttacatgggtatattgcatgatttcctgaagtttggggtacggttgaacccgtcaacctgagcatagcatgcaacaggtagtttttcaaacccccctccctcctggccccttttgtagtccccagggcctatttttttttcttctttatgtccatgcatgaccaatgtttagctcccacttatgggcaagaacatgctcataagtatatgttcttgctcataaatatttggtatttgattttctgtttgtgttaattcgcttaggatagtgacctccagttgcatccaagttgctgcaaaggacttgatttcattcttttttatggctgtatagtattccatggtttatatgtaccacattttctctatccaatccaccattgatcaatgaacacctaggttgattccacatcttgatattgtgaatagtgtggcagtaaacaagacacgtgcaagtatctttttggtagaataattcgttttcccctgggtatatcccagtaatgggattgctgggttgaatactagttctatctttagttctttgagaaatcttcaaactgctttccacagcagctaaactaatttacattcccaccagcagtgtataaatgttccctcttctctgctggcttaccattctgatttgtcctatagacaaacccatctgcttctaaaggttaatggagaatcagaaaaattaaaatttcaattggcaaaacaaatgaaagtttctgtatgatacatagatatccaaatatgtgatcgttttatatgtaaaatatgaactccaacaagtgattgcttttgtttcttagatgggtagcctatgaaaatcctgacttcacaggagaacagtatatactggataaaggattttataccagttttgaggactggggaggcaaaaattgtaagatctcttctgttcaacctatatgtttggtaaggagttatatttttgtatgagaatatttaactgaattctggatttccttaatgtgtgttcctggttcatgtaatagtaattgctatggaaaatattctgagtttatttttagcagtaattgctaataatctagaagaaaaaaactttttcaatgtgtttgttctattcatttccttttctccttcctttaaaaatttttaggattctttcactggcccaaggagacgaaatcaggtaactttaaaaatattcttttatattaatatataaagggccttccattgaaaagctgaacttatgtttcaaatgtcagacatttggggccgggtgtggtggctcacgcctgtaatcccagcactttgggaggtcaaggcaggtggatcacttgagctcaggagttcaagaccagcctgaccaacatggggaaaccccgtctttactaaaaagacaaaaattagctgggtgtggtggcttgtgtctataagctcagctactcaggaagctgaggcaggagaattgcttgaaccccaagaggcagatgttggagtgagccgagatcgcaccactgcactccagcctgagtgacagagactctgtctcaaaaaaaaaaaaaaaaaaaaaaaaaaaaaaatcagacatttgggacattttgttagttttactcatttttatgcctgaaagcataattgtatttaaaaaataagatttaagtttactttaatggttaattgacagtactgacccatgtctaaataattcttataaaatgcttattgtataaagctgaattttatatcattacattgactcagtttatattaatacattgagattaatatttcaaacaatagcatctagttattgtgatggtaaaatgaattttcatatttgctgtgtcgacactagacattttttatggtctcactcaagctttctgaatgctgattcttaacatcaactggggtgtacatttgttatttcggccttttaatggaagtgttcacagagccataattatagaggaacaaacaccactatagcctcctttattggcattcacaggattccgataagtcagcaagtgtcttccattgagaaggaaggaaactacactatgtctttccaaaatactgtttgtcgttaatgtcagaactgatgaacaatgatttctgaccacaataaagctttaaaatacctcacagcttcacaacagggtgttctatagaaagttacctttgttgttgcattttactttgatgtctctgaattaaataaatagtcacgaatggcgcagctaacatgtttctaattgatcatgaatgtagacatggaaaattaaaggatttctaaaattcgtaccagtttactgtaacaaaagtcagcaggtcatgtttaggtcatcatttcaaaggctaaattagttaatgtgtttaggaaaataattttatgtgtttctgtttactttttcaaagattcacttgttttcagaaccacagtttcaaggtcacagtcaaagttttgaagaaacaacaagtcaaattgatgattcattttctaccaagtcttgcagagtttcaggaggcaggtaagtgaaacaaaggcctggcagagctgaatcactggagtaaaacagaattcacacatcagcaagtatatagtgatgcctgttaggtgcttggcactatgcgaaaccaccatcttagtccaatggcgtgcttcgtgatatctgagtaccagacgccagaggacacgggcttcaggttggttggagaagctgaagatcatctcattgtgtaatggaattcagagcaggttctttactctgtatgtcttcccatcatctagaaagggagagttgggctctagttaatccaaggtacctcccaaggtggattgttcaaaggacaggatcggcactctgcattaacaggaaggtagaaagtacacgctggagtggagctggtggacacgcgaatcagggagcataccagtccggcttgctgggagggctttgtactgggaggagaagcaaagctgagcacactgagtttagatggcttccacaggaaacacaagacccagggcaaaggcaatgggctcaattgtttcatgctgaaacaatccttgtacaaaagcttcatggagaggggagagcccaaggtcagggaaactcggtcaggaaagccttggagcaatctgtgcaagaggtgttgaggatttaagtctcttaataatagtagtaatagtgcctttaatcacgtggttctttatggttgaaataatgctatcctgtcctttagtattgcacagcaaaaaagcactgactttgcattcaaatacacagatggaggccgggtgcagtggctcctgcctgtaatcccaacacttagggaagccaaggcaggcagatcacttgaggtcaggagatcgagaccagcctggccatcatggcaaaaccctgtctttactaaaaatacaaaaattagccgggcatggtgacacacctgtaatcccagctacttgggaggctgaggcaggagaattgcgtgaacccaggaggcagaggttgcagtaagttgagatcatagcactgcactctagcctgggcaacagagcaagactgtctcaggaaaaaacaaaaaaggcaaatacatagttggatagtaaagcttcctagtttgttggacatactgctaccacatccccactcctcgttatcccctgcctgcttcatttattacctccagtcctgtgcatgtttaaaattacctgtctcagctcactagagtattaacttcaggagagcagggactttggttctctgctgtatccccagcaatagaaaagtacctgacacataatcctcaaaaggcatttgttgggttaaaaacaacaacaacagggccaggcacggtgactcacacctgtaatcccagcactttgggaggccgaggtgggcagatcaccaggtcaggatttcgagaccagtctggccaatatggtgaaaccccgtctctactaaaaatacaaaaattagccaggtgtggtggcatgcacctgtagtcccagctactcaggaggatgaggcagaagaattgcttgaacccaggaggcagaggttgcagtgagccgagatcatgccactgcactccagcctgtgtgacagagcgagattctgtccccccgccaccaaaagaaaagaaaaaaaggaaaaaaaaaaaaaaggcccacaaacttctaggggagcatggcaaatcaccattttatgaataatgttgataccagagaggctaagtgacttgtctaagtcaatatagtattttgactcctggcccagtgcagaggtattagaaatgaggatagaggagtgtgcgagaaattttggaaggaaatcaatagaccaaatcaataggccttggtgattaactagtcacaaagcttgaagaaggattattcaaaaaggacttgagggcttgaagctccactggctgggcaaacggtggcacccatgagaagagcaaggaaggctggaggctggggaagtcagaaagaacgtggagaaagaagtttgtttcccaaatgcaaagttaactgacttattatgaatattattttgccacaagcagaaatgcaataaatatatccaaatatttttgaagaaagaactctgtttgccagaagcattgtgtttattttatagcaggccacctctaaaaatcagacttcttgaataggagtgctcaagttgcatattctgtgcatgtgtgtggtttttcccattgtagctgggttgtatatgatggagaaaatttcactggtaatcaatacgtgttggaagaaggccattatccttgtctgtctgcaatgggatgcccgcctggagcaactttcaagtctcttcgttttatagatgttgtaagtatgtcattgtgaatagtgttgcagaaatgtatgcctcatatagctgatggtcagagtgaggtaaccagccggtagaacctgctcttaaagttagttaagggcttggagatggaactgtccatttggctctgtgtacatctagtttattgattctaactggtacacgttttccaccaccctgttttactcacttaatcctcatatgcatatccctatggacctgagtgggagtctcttggactatatattaggagtagaattactggatttcacatgtaagaacaggcagtttcattcagtactgccagatcccaccacttgagactcccaccagcagtacacattgttgccattactgaatattctctcattctaatttttgtcaacttgatagaatgagcagaaagcagtatgtcgtcattgggttaatttgtatttcactattagtgaggctggtatctcttatttataatttgcattttctattcaaggaattgtgtattgtatcctttgcaatttggcttcctctacctttggttgttattattgaagaaattccttataggtttttagtctattattattctgtgttttagagatttgcaatcaaatgacttctcccagtttgccactatgtgctaatccagattatagtgccctcttttggacagaagtctttcagtttgatgtagtggaagtaatattcaatagaacaaaactgcaagatcatgttgagatattaaagtctggaagtatctgtcgtttctgacatttttattagtttttggtaactgctttctcataaaaagctttaaacacacgtaattgctcattttagttttaaatgtaggaagaacgtatgtgagttggttttcatctcatccctgcctgcctgtttaaatagcaaaaatgctactgagacatgaaaatagtaacaaagaaacatgaaatgaggtagtaagattcattagcttacaagtaatgaataagactttgattgttattctgcctagaattctaaaagctacctacaagtatatatttgaaaatttcaatgccttccctcaaccagaacttggcatatatgctcacaacactctgaggctatagatgacatctttttatgttttaattgtgaggaaatgaatgttttacccatatgaagactacatatctttgtgacttaatacttcaaaattatttaattgctttttaatactaaagtgtttagaacatttttgggcttgccatctcaaaagtgcaataaaagtgcaaagtagtaatactactataatttttgtcttctttcctccatgtatgttttatataaactaattcctagaccacacaaactacttctacacactaacatgctctgtttactgatggacaaaatctttttaccagtcaggacacatccacataaatgaagcagtaaggtaccgcaccctttccacaaactttaagcaggatagggaaaaaattgtaatccccacatgcttttattttttttttttttgaaatggagtctcactcagttgcccaggctggagtgcagtggcatgatcttgactcactgcaacctccgcctcccaggttcaagtgattctctagtctcccactcagcctccaaagtagctgggattacaagcatgcaccaccatgcccggctaatttttttgtgtttgtttgtttgtttttgtatttttaatagagatggggtttcaccctgttggccaggctgatctcaaactcctgacctcaagtgatccgtccacctcggcctcccaaagtgctgggatgacaggcgtaagccaccatgcccggcctcccacatgctttttaatgcatcatttatgatcttagcagtactatcattagagattaatgtagaatcaaaagtgtctataatttgaaaaaacaggcataagctgccaacttttcattttcctgaacagtgaacgtttgtgctgttgtcctctttaaaatgattgacagtttgaacatagagcttccatcctgttgttttttttctctcctcttgacaatgattcctacaggaaagtttgggagcatgagtacacagaatcattgtcttagtgatgaacagaaaaaaaaaagacatttgaaaatacatacaagaggaaggttccctgattaggcaataccactgtacactaagtgactaaacatcagatgccacagccctctgacccttggcaattatgtccatgactttccagcccctccttgtcccagtgaaaatggctaagtcaaaaataaatgccatcagaagtgttgatattcccagcgtatacccatttctcttttttttttccccctgttttacaaactatttatatttacctgccttcctatgcaatggagaaactaactgcccctctgtgctttctctctagcttggagtacacaaacatccaggctcccttggaaaaggagtttatggaaaggccaaatctagcagattttttgtgctttgtccttgtaacaagatgattttcacataagtttgaattattaacaaagatgaataacagaacattgtttttgttcctcaacaggaattttctgaaccaacaattattctctttgaaagagaagacttcaaaggaaaaaagattgaacttaatgcagaaactgtcaatctccgatccctgggattcaacacacaaatacgctctgttcaggttattggtggcatgtgagttacctacttgttgactcaataaaatagatcattttaaaaatcaagtttgggctgggcacagtggctcacgcctgtattcccaacactttaggaggccgaggtagaaggatcatttgaatccagggattcaagaaaagcctgggcaacaaagtgagaccccatctctaccaaaaatttaaaaattagccaggtgtcgtggcacatgcctgtggccccagctacgtaggaggctgaggccgaaggatcacttgagcacagtaggttgaggctgcagtgagccgtgttcacgccactgtactccagtctgagtgacaaagcaagaccctatcttaatttaaaaaaaaaaaattgatcagatttctccctctcttatattatcttaaactaattgacatataccctctctttttgtaagggttaataattatgcacctttgtagaacacttttccactgggaaaagtcatatgtaaagcatcttttatttcattatccagatttttagtttatttaaggtaaggattttgtctttaacacctctcatagtctagcaagtaagaaagagctgactttacttatccctttaaaaaagagcaagtcctctgattttggagctcagggttgggattttcctttagctgggaatgactggcagatgttatacaaatgattaaaggtcaacttggaaagatttttttcccctcaacttcgaatacttttgaataagatataaaaatgaatgagtaccatcaatgtaatacatgtttttaagaaagtatttttcttttattcacaaaaacaataggtatggtctacctgtgtacaacagatgttggggtggactacatctatttaaaaaataatcaggccgggctgggtgcagtggctcctgcctgtaatcccagcactttgggagggcaaagcgggtggatcacctgaggtcaggagttcaggaccagcctggccaacgtggtgaaaccctgtctctactaaaaaatacaaaaattagccaggtgtggtggtggggcccctgtaatcccagctactcaggaggctgaggcaggagaatcacttgaacccaggaggtggaggttgcagtgagctgagatcacaccagtgcactccagcctgggtgacaagagtgaaactccatctaaaaaagaaaataaaaaaaatcacagaagctgggcgcagtgactcacgtctgtaaccctagcactttgggaggtcaaagtgggcagatcactggaacccagcagttccagacaagcctgggcaacatgttgaaaccctgtctctattgaaaacacaaaaattagtcgggtgtggtggtgcacgcctgtagtcccagctactcaggaggctgaggtgggagatcacttgagtctgggaggttgaggctgcagtgagctgtgatcgtgccactgcccttcagcctgggcaacagagtgagacctacctggaaaaaaaaattatagaatattagggtggtagaattatgggtgatttttttgcagtaggttttaatattttgtttttatgataagatgactaaaatgataaaattttatccaggatttaagttccaggattaaaagtagagtgcattcttccctgatgtaatatgcaagagaggagggcgctgggctgcttccacgccagtctgcgcttaaacccatacttcctcaggtgtgcagcagtagcatctgagcggaagggaactgagtatcttagcagttttttagatttaacaaagattactctcactgcagacaaaactttttatttaaccctatttagcacctactaagagctttggaaatattaacaacttaaagacccattattacaactgaagctattttatgaatagttcccaggaagaactgaggaatccactaaaagacaatatttcactgctttacggaggaaaaaacttacctatttctcttcaagaatggaactttttggcataagtactcatgtaacaaaaatttgctatttgtcaagaaattacttcttttaagtgttctagaaaagatcatttttcccccaatgtatgttaaaagtatatagttcagtctagaaatggaaagcattctaaaaataaatgtaattggggtccactgtcaaatgaaaattgccacttactgtggttatttttgttttcagatgggttacttatgaatatggcagttacagagggcgacagttcctattgtcacctgcagaagtacctaattggtatgaattcagtggctgtcgccaaataggttctctacgaccttttgttcaggtattttcttcctctccatgctctgcatagactcttctctgaaatttttttgtaaatgcaatccaactttttatccaatttttttattcaaagtttataactggcctcaccctataaactccttccctgccccaataatctgggctcagtttctggtgctaagaggtgtggctgcttcagaaggccatcaaactgaacatcaaacgcagttatccacaggcaggcaccctgcctcaggcgctttgacattttgtcaaactcttctcattgagaaaatttaaaacctctgagactcttgagtatggtaattacccttaatccatatctcactttggattcttcctgatattcatgcttgttcagtgcttccagcagcacatctggtataacaactgctgggggttttgtcttctagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcagggtgagctttaggattccacgggggcctgtgatggctttgctaggaggtgactcatcctttcatatgcttttgatcttttcttcaagtagatgcaatttcacaattcctggagtactttcagaaatgaatttgtttttttcatgacagtatatcctagctctgatagaaccagtctaggaacttaaaatgaaaggtaaatatagcactgatccaagatagaatatttatttctatgcttgatttttatatagtagtagaaaaaggaagtgtgttattcttccctttttccttaatgtaactgttacagaaacaaactataagctccagccctgtcaacaaaaatcactcttggtttgttttggggaaatccacagaacgggatgaagggtaaagagatccctctgtgtgctgcacagtccatttcctaagtgtcatacgttgtaaattagaaaatggcccatgtccctcctgcatcattcctactattaacagacacttaaaagctgactgtagtaagatttttatgaaagaagctcatgcttctatggtagataaaacttttttactccttgattttgtgagcttgaccgttggctcctgattttctttaaaaaaacaaaacaaaacaaaacaaaaaaccaaaaaaaacctggtgccccgtgagtcagcagaaggaacacagccttgcgaaaaggagtacaactcgttaattgggtctgttgtgctggagggggaattctttcagtaaacagaagtactgtttggacatgcatagaagaactagcaggaggaacagaagtagttgtaatatggaatcatgaaaagaagctttctgcctttgaattgtcttaatccaagaaaatggtgtctttcagcagttatttctaacagacatttcagtgatgttatttaacaactttgaattcaataggtcaatgagaaaaagtctcctagattatcacagtgctttcatctcaatatagaataatatactttaattttttttagacggggtcttgctctgtcaccaggctggagtgcagtggcactatctcggctcacttcaacctgtacctcccgggttcacgcgattctcctgcctcagcctctcgagtagctgggactacaggcgtgtgccaccacgcccagctaacttttttgtatttttagtagagacggggtttcaccatgttggccaggatggtcttgatctcctgacctcgtgatccacctgccttggcctcccaaagtgctgggattacaggcataagccactgcgcctggcctacaataatacacttttaacaggcatttttatagcaacattgttttgtttttgtgtttgagacagagtctagctctgttgcccaggctggagtgtagtggtgcaatcacagctcactgtagcttcgacctcctgggctcaagggatcctcccacctcagcctcctgagtagctggggcccacaagtgcatgccactatacctggctaatttttaaaacttttctgtagagatagggtctcacaagtgatcctctcaccttggcctcccaaagagttgggattacagttgtgagccactgtacctggccagtaatttttgttaatggcatgtgaacatgactgccatacattatttatatattaagggtagattcacttcagggaagggctcataaaatctttgcattaaaacaccctctagtgagtctgcatttttctgttttcatagctggaaagcatgcctgtttagaaaattttaattctcatgaaggaaagacaaatgctaataaatgcaattccgagttttaaaatgataaaatgccctttagccacccagtgctacaaaattagaggtgcagtcatatactggaaggtcaggccaagcagaggtggagatgtcagagggagatatagctacagaacctgcctgggatcatggtcacttatgacagggaaaaatatgatgggcagttctaatgttatgaggctttccctactagtaagatagtcttgcaaagggcagaagtctctgacgatgcacaaacattgagattttcccatcattcgtgtcatctgaaataaatggcataaatatttattgtccgattctagttggctaagagctgaactgcctcatgtggggtaaatgaagctaggaactaagataattttaaagcccaatgtaaccagagaaataattgctatgagacttacagctggatacatatttaagatatctggtcttttccactgagcagatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaaggtaagggtcacttcctttattttctttattgtaatgtgtatgtcttttagttaaggaaaaatctattcataacttttgaaaatgatgaatgtattattagtagtaacagtaagagagcccctactgtgtgccagctgctgtgctagccactttcagtacaccatgtcccgtcatcttcacagccgccctatgaggcctacattatcccctctccctcttttctccccagttttacagacaaaacaacaacaacaacaacaacaaaaccccggaagctcaaaggggttggccagtttggccacaatctcacagctgtaactgctgaaccagaatctggccataggctgacttcaaacatttattttattataatagtgttaggctaaaaatcacaagctgaaaggccgtgattgcacttagttcggtagagttgatgattctcatgtatacacgtgacctttcattgaaaagatctaagatctcaaaggaattaacacagcctacaggatttcaatgcaacatgtgttcaatgaagctaatagggagtgaactgatggtgcttgggggagaataaatttagcgtggttgtcctcaaactttatttgcatcagaatcacctggagggcgggttaaaatagactgtggggccacatcctcagagactgagtctgtaggtctggggtggggcctgataattccttttctaacaagttcccaggtgttgccaatgctgctggtctgaggcccacacccggagaaccactgatagtcatttaaaaataacataagaatgacctaacctctgtgtgggaactcagtgaactagtgtgttgctattgacaggtgcagatggtgtgttcatgtcatctggggtaattctgctttaaattaatgggcacttttttattccctatcaggaaagtcagcacaattgtgttttgtagcgaactggtgataatgtaaccatactacatactccattaatttttttaaatttttatgagtatattacatactctattttaaatcatcactacaaaatgactcaattttactttaatcagggatttaggccaatgctgtcattaaagtttatgatgtaggggtaaagagccaggtgccgtggctcacgcctgtaatcccagcactttgggaggccctggtgggtggatcacgaggtcaggagatcgagaccatcctggctaacatggtgaaaccccgtctctactaaaaaatacaaaaaaattagctgggtgtggtggtgggcgcctgtagtcccagctatttgggaggctgaggcaggagaatcgcgtcaacccgggaggcggacgttgcactgagccgagattgtgccactgcactccagcctaggcgacagggcaagacttcgtctcaaaaaaaaaaaagttgtagggacaagaaagtgctgtaatctgatttttaaaaaacaacttttctggataatggagaacgaatctggacattttcatcaggggctttggtaactgtatggggagcaaaagtggctgtcacttctgaatgatctccaggtaggtagcttggccaacccacttaaaacaatggacttaggatcagacagaatctgagaagttggaaagatgctcagaagcaaacaatgcctttgccttcattaaagggggcacttagggaacacaaactaagcactgcaactacaggctggatggagaccacaaagatcatataaaatgcaagtagtacccttggatataagaaaataaatgcaatattcagaaaccaaacagtaacatatagtacagctccctcaccttacatttggtacaacagatttgtcaatatgtagacaggtgaaatactcattttatagatgatcaacctgaggttcaaactagttaagaattatgcagatctttgtttattcttattttgataaactttattgcactagagtgcttcagtgttgacaagagtttcaaaatctccagagacaccaaagaaatgtgactcaattggaaaaaatggagtttttgacacaatgttagagaaagtagggtatgtagttctcaaaggaaatctgaccaaaccttcctgttttttacaaatgtgatctgcttcctatgtccagggtggacaacactatgatccttagctagagctttcttctcttattctttcaacatgtattcacggggtacacactatgtgccaggctcggtgctagacacggagggcaccagcgtgaaaaaaaaaaaaaaaagcctcctccttggcttcagacagtttacgttctagatgcgctaggcacacaggatgtccctgacttgttacattagcagcggaccagaaggaaggacacctcactccttgtcttggctctgacatgaaccgtgggactctaggtttcttaagacttctttttaaagctccagagccccttcctaaatgacactatataaattactcaagtgcctgctgagtaagcataatgtcccgtatatttgtgaaatctcagtatctagcacggtagcaacaacagtctttttttttttttttttttttttttgagacggagtctcactctgtcgtccaggctggagtgcaatgacacgatctcggctcactgcaacctccgcctcctgggttcaagcaattctcctgccttagcctcctgagtagctgggattacaggtgcctgccaccacgcccggctagctacaacagttttaattccttgttaaactgaatttaattttctcagactgggagaatggtgccatcttgtggacatgagagagcagcgccgcacgtcccacaccccatgcaaaggaaaatataaacacgtctcttctcgttggtgcacttactagcagaccatgatttccattagctacaactactgaaccatttgttatctattaaaattgccctaagaattattagatcatgcatctgtcttctagctcatcttcttgtgtttgggaaatgagttcttttggtagacattcatgtattattccagaccacataccttgtaacaacagtggaagctgattcatgttcactttaaaaaacatgaagtctgcacaatttaaacactctccaaaggcaagagaatgaatcaaattatttctcaagaactttctagttttcatgattctagttgaatttatatgaaagtattttaagatactttacttttaaaatacaaaagatactcttaaaatacaaaaagtattttaacatactataatgaagaatgaaaagagacattgtgactttaatacttcctgaaatttcagtggagtatgctgtgtgtctctgtctcggcagagtgtagggtttgctggtagttttttccctactgctacaaacttacacataaaggcccaaaacaccttacccttgtattctatagtacatctagccatacatctagctgtgtagaggctgtagattaccaatgatgataaatcagtgtctcacaagagaagagacgatttccttcctcaactataatacctagatttattgtgtaaattcccaaacctttttcatattttgtaaatgcttcaaaggtgaaaagaatgtttatttcttcttgatccaaggaggaagcatgctttcaataccagtcactccctgcatcaaaatgcacagatttttactttgatggggtctttgttgatacatccttggtgctgaggtttatgctaaaaaaaggataagccatctgaagggatctttattctacactggaaaaaaaaaaatcagataacccttttgttaatgatacttctccaaagaaagaagccatgaggctgtttttagcactaaagtatctgaaacatccagtaagcacctttggaaaatcttacaaacattctggtaacagggagagagttcatgataatagttttacaatactgtggtactcagcatcctaaatgctatgaaattttatccaccaactgagtccccagtagtgacaatgctaccgcgtccccttatgtacttccgggtgtcatccaaacctcccctttgacctaatacagcccgttttcattgttcatgcaagtgctgttcctcgataaccattcctcccacctttccaccactgccaggactacctgctctttcctcgctggtgtctcgaatctaccatctcaccaccaaatatatgttagtctctttactccttttcccttctctcgggttttcccagttcccttgaatttcagacattgtaagagtgactgtggactagctcttaagaactgggtagaaaaaggagcccgtgaggtgggatgtcctgtgtgaaggtgctggtgccccaatggtgggatctggacagattcacccatggcaggttgaccctctcatcccacaggggcccaggcttccctccctgccttgcctccttgaggcatgcagttctacaccttgtttacttgcttacttttgctgtactggtgttaggggaattgtgtctgctatagacccttcaccatgggtacattcatcttttattattttcctttcttttagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgatgaa

SEQ ID NO: 312 - DNA, 66150 bp, Homo sapiens
tgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggtgagcgcccggccccaggcgcggactgctaggcacgcgctggaacgcggacccggcgggcgcgggggcggggactcggggcggggcgccctgctcggccccctccgggcctcgttgctaccccgagccttcgcgcggccccacggccccgatccctaggcgtggctgggggccccggaggaacctgcccgagccgtacctggcgctgctactgcccggcttgggtgaccttggggcagtcccttcgccccgggcacctcagctccgtccttgcaacaggggggagctcctgggggaaaccccgagggcggggcggggtgctgagcgcgggtcccggcgcatcgcttctgcctagaaaactctcattgtcatcagattgacctcaccgcgggggccggctttcgctttctttagtggcttggtgtgaaggccgagccagtggtttgggcaatttccctcccatcaggacggaggctcttggtgtgtgggttggaggagtggggctgggcccaaggagacgattatagttgatcgggaggggccagggtccttgctgagaggacccagccgatactcgggcctctgtgttatggctgagggacgtaagacaccaaggaggaagtgactgccaagatctcagctggatggaagcatagttgggaccgggaccagctgtggggctcccacgtagctttgttcccagctctctttctgcctctattgatgagttatgtgttgactgggagcatctagctccaagtctcaccctccatctcctcgtggggttctttgtggtggaaaggagagaaggaagaggagagagaacttgggcatcatggggacatctagattgggtcctcagatcctggcgtctcatctgatctgatgtctcagtctcctgggtgtctccggacacccacaggccagatttctctgagtgtgggccaggtccacaagtgggggaggactgctagacatgccagggcctgcctgggaccccttggggcctgggaacctgcattttcaacccattccccatgtgagttttacgtccactcaggtttgaaaaactgctctgcccaggttttgtaaggtgtgactaggtgagggcctggggccactgggatgaagtgaggggaaccagcacagtttgggggcactctgaaggggatggactcagagctaggcagaacgcactgttgcctgcctgctggggagagcacagctgtatcccaggcccagcagcgggtcagcctggcctttgggtggttccaccctggggtttccctagaggttccgagggctgatggccctacatcagatggagcagtttgctgttgtcctctttcatctctgatattcttccagcctgcctctggctgagtgaccttggtcgaggttgcttaaccccctgggtcccagtttcctcatctgtaaaacgggctgatgcttatacagccctcagaaccacacctggctcagaagtccccaaatggtagctgctacaattgctcataaaggaagataagtgactagctaatgaccataatcatagtaagcagtggcatgacacagatatcaaaaagttgagtggcacttcctgtcacctgggacctgagctcacttgatgtccgttcttcacttgggctgaacagaataacatacatgtcatttacagcccgcttcgggatcccactgtggctgaaatgtcattgctaatcactcgtggccctccctcccactgagcatccatcgcagaacactcgcgtcagccactattggttggcactggcacccaggtgcaacccatcagctagctgcctgggtcatgttgccagtgccagcagtgttctgcgcccatccagtccacaggtcctctccagctgtgctttttccctttctcttctccatccttccctggggccttgcagatacttgttcttctctttgttcatctcttctggtccttgcctttgtgccgcactggtttcctagactccccgcctctcctgtctccttaatgagaactccgtcaggtcaagggtgggaggcaggccgggcctcagcagcattttggtgtgtttccccaagggcagaccggggaccgtggagacatttgagatgattttaggggttgcccccatggaccattcaatcacccgatgagaaagctttcttttcacatctctgtcaattttgttgattatgtcaaggagaaagagtcactgggtggtaatatatgcatttttaacacctaacactgtccatttttcttaagggaactttcagcatgttctgcagcagcgctcagcttgaatttaatatttgctttgttttcactatatctgttttactcttcatagctttattgagatgtagttcatgtaccacacaactcatccattgtaaacatgatttgatgatttttagttaaattatagaattgtgcagtcgtctggccaggcgcggtggctcacgcctataatcccatcactttgggaggccaaggcgggcggatcacaaggtcaggagatggagaccatcctggctaacacggggaaaccccgtctctactaaaaatacaaaaaaatttagccgggcgtgatggcaggcgtctatagtcccagctacgcgggaggctgaggcaggctgaattgcttgaagctgagaggtggaggctgcagtgagccgagattgcgccactgcactccagcctgggtgacagagcgagactccgtctcaaaaaaaaaggctgggcgcggtggttcacgcctgtaatcccagcactttgggaggctgaggcaggtggatcacaaggtcaggagatcaagaccatcctggctaacaccgtgaaaccccatctctaccaaaaatacaaaaaattagctgggtgtggtggcgggcacctgtagtcccagctactcaggaagctgaggcaggagaatggtgtgaacccaggaggcggaggttgcagtgagccgagactgcgccactgcactccagcctaggtgtcagagtgagactccgtctcaaaaaaaaaaaaaaaaaagaattgtgggtgggtgcggtggctcacgcctgtaatcccagcactttgggaggccgaggcaggcggatcacgaggtcaggagatcgagaccatcctggctaacacggtgaaaccccatgtctactaaaaatacaaaaaattagccaggtgtggtggcaggcgcttgtagtcccagccactcgggaggctgaggcaggagaatggcatgaacccgggaggtgaagcttgcagtgagccgagatcacgccattgcactccagctgggcgatagagtgtgactctgtctccaaaaaaaaaaaaaaaaaaggaggggacattgaagcaacaacaacaaaaaaaagaattgtgcagtcatcaccacaattgcagacatttcccttgtaaaagtttccttccatctgtttgcagagtccctaccccaacccccaccctcagcccatcagcgatctgctttcttttttctttgagatggagtgttgctctgtcgcccaggttgcaatgcagtggcatgatctcggctcagtgcaacgtccgcctcctgggttcaagcaattctcctgtttcagcctcctgagtagcttggattacaggtgcgcaccaccacgcccggctaatttttaaatttttggtacagatgaggtttcaccatattggccagtctggtctcgagctcctgacctcaggtgatctgcctgccttggcctcccaaagtgctaggattacaggtgtgagccactatgcccagccttttctgtttttttttgagacagtctcgctctgttgccctggagtgcagtggtgcaatcttggcttactgcaacctctgcctcctggtttcaagtgattctcctgcctcagcctcccaagtagctgggattataggcactggccactatgccaggctaatttttgtatttttagtagacacggggtttcactatgttgggaaggctggtttcgaactcccgacctcaggtgatctgcccacctcagcctccaaagtgctgggattacaggggtgagccactgcacctggcctgctttctgttcgtatgtgtgtgtgtgtgtgtgtgtgtgtgtgtgtgtgtgtgtgtgaaaagtgtctatttgagtcttttgtccaattttcaaaaactggattgtttatcttacggagttgtaacaaagagttctttatgtgttctggataggattctcctgtcagccatgtgatttgcaaatattttctcccagtctggcttgtcttttaattttcttaatggtgtttcttttgaagagcaaaagttttgaattttgacgaagtctcatttactgctttttaagtggatactgcttttggagttatgtttaagaaatcttgggcccaggcatggtggctcacgcctgtaatcccagcactttgggaggccaaggtgggcggatcatgaggtaaagagattgagaccatcctggccaacatggtgaaaccccatctctactaaaaatacaaaaattagctgggcgtggtggcacacacctgtagtcccagctgctcaggaggctgaggcaggagaattgtttgaacccgggaggcgggggttgcagtgagcctagatcgcgccactgcactccagcctggtgaaagagcgagacaccgtctcaaaaaaaaaaaaaaaatcatacaggcggctgggtgtggtggttcatgcctgtcatctcagcattttgggaggctgaggtgggcggatcacctgaggtcaggagttcgagaccagcctggccaacaaggtgaaacctcgtctctactaaaaatacaaaaatgagctggacgcaatggcgcacgcccgtaatcccagctactcaggaggctgagtcaggagaattgcttgaacctgggaggtggagttgggttgcagtgagccaagatcatgccactgcactgcagcctgggcaaacagtgagacaccatctcaaaaaaaaaaaaaaaaaaaaagcgcaggtgcagtggctcgcgcctgtaatcctagcactttgggagactgagatgggtggattgcctgagctcaggagtttgagaccagcctgggcaacatggtgaaactccatgtctcctaaaatacaaaaaattagttgggtgtggcagcatgtgcctgtagtcccagctaattgggaggccgaggcagaagaatcgctggaacccggagcgcggcagaggttgcagtgagccgagattatgccactgcactccagcctgagcgacagagtgagacgccgtctcaaaaaaaaaaaaacaaatagaaagaaaagaaatctttgcctaggtcaaggtcacaaagattttctcctatttttttctagcattttgttgttgttgttgttgttggttttttttgagatggagtctccctctgtcacccaggctggagtgtagtggcatgatcttagctcactgcagcctctgcccgggttccagcgattcttctacctcagcctactgagtagctgagattacaggtgcgagccaccacgcccggctaatttttggattttttagtagagacggggttttcaccatattggccaggctgatctcaaactgaccttgtgatctgcctgccttggcctcccagattgctgggattacaggcgtgagccgctgtgcccggccttttctagaagttttatagttttagctcttacatttaggtctttgatccatttagagttaattcttttttttttttttttttttaattttgagatagggtcttactctgtcattcaggctagagtatagcggcatgatgtcactctagccttgacttcctggctcaggtgattctcccacctcagcctcccaagtagctgggttttcccagctatgtatgtgtaccactatgcccagcaaagtttttgtattttttttgtagagacagggtttcaccgtgttgtccaggctggcctcaaagtcctggactcaagcaatctgcccaccttggccttccagagtgctgggattacaggtgtgagccgctgtagctgaccaaattaatttgtttcacttatggcttgagataaagatctaaaccccccttttttgtggatggaattcaattattttagtatcatttgttgtagagactatcatcttcccatcaaattgcctttgcacctttgtcaaaaattagttgacctaagccaggcattgtggctggataacaaagcaagaccatgtctcttaaaaatcaaaacaacagcgacaagaaccccaccagttaaccatgaatgtgagggtttattttgggactctccattctgttccattgatttatgtgtgtcccagaagttctcaactggggcatttttgccctctcaagggacatttggccatgtctggagacatttgtgattgtcacagctgggggcatctgttgggtagaggccacaggacagtcccccacaattaagaataaatcggcccagaatatccatagtgcttagactgagaaatcctggtctgttcttagaccagcagcacactggcttgtttacagtagtttgatagtaagttgtgaaatcaggtagcataagttctccaactttgttctctttcaaaattgttttggttatgctaagttctttgcatttccatatacattttataattagcctgtcaattatttctacaaaagcagcctgcaattttgataagtattacattggatatataaatctatgtggtgagaattgctgtctttacagtgctgactctgggaatccatgaacatggtatatctctacattaattttgatatttagcttctcagttgtttttttttttcagataactttacctatttaaggcaagtgatatttgccaatctattactgatatattgccttcccaatctagtagtgataaaaaatttccttttttttttttttttttttttttgagatggagtcttgctcttgtcacccaggctggagggcaatggcgcaatcttgactcactccaacctctgcctcgcaggttcaagtgattctctcctgcctcagcctcctgtgttgctgggactacaggtgcatgccaccacgcccagctaatttttgtatttttagtagagatgggtttcaccatgttggcagggatggtcttgatctattgaccttttgacccgcctacctcagcctccggaagagctggtattacaggcatgagccactgcgcccggctattcttaataacagttttgttgagatctaattcacagcatacgagtcacactgagaacatctagtccagtggttttttttgtttgtttgtttgtttttgagacggagtcttgctctgtcgcccaggctggagtgcagtggcgcaatctctgctcactgcaagctctgcctcccgggttcacgccattctcctgtctcagcctcctgagtagctgggactacaggcacccgccactacgtctggctaatttttttgtatttttagtggagatgtggtttcaccgtgttagccaggatggtctcgatctcctgacctcttgatccgcccgtctcggcctcccaaaatgcggggattacaggcatgagccaccgtgccgggaccagtggtttttggtatacttgtgttgtgcagccatcaccactgtctaattccagaacatcttcatcacaccaaaaagaaacccagtggccatgaaacagtcactcacggccaggcgtggtggctcacatttgtaatcccagcactttgggaggccagggcaggcagattacttgagctcagaagtttgagaccaccctgggcaacacggcaaaaccttgtctctacaaaaaataaaaaaattatctgggtgtggtggcgtccacctttagtcctagctacctggtgggctgaggtgggaggattgcttgagctcaggaggtcgaggctgcagtgagctatgattgccccactgtactccagcctgggcagcagagtgagactctgtctctaaagaataaattaataaaatttggccgggtgcagtggctcacacctgtaatcctagtactttgggaggctgaggcgggtggaccatttgaggttaggagtttgagagcagcctggccagcatggtaaaaccccacctctattaaaaatccaaaaaattagctggacgtggtggtgggtgcccataatcccagctactcaggaggctgaggcaggagaactgctttaaaccaggaagcagagcttgcagtgagctgagatcacgccactgcattccagcctgggcaacagtgcccaggctttatttattgaaaaattaataaaaattggctgggtgccgtggctcacacctgtaatctcagcactttgggaggccaaggcgggtggatcacctgaggtcggaggtttgagaccagactgaccaagatggagaagccccatctctactaaaaatacaaaatgagctgggcgtggtggtacgtgcctgtaatcccagctactcgggaggctgaggcaggagaatcacttgaacccaggaggcagaggttgcagtgagccgaggtcgtgccattgcactccagcctgggcaactagagcaaaactctgtctcaaaaaatatatctatcaataaaaaaaattattattattattattgagacggagtctcactctttctcccaggccggactgcagtggtgctatctcggctcactgcaagctctgcctcccgggttcacgccattctcctgcctcagcctcccgagtagctgggactgcaggcgcccgccaccgcgcccggccaattttttgtattattagtagagacggggtttcaccgtgttagccaggatggtctccatctcctgacctcgtgataaaaatttttttaaaaagggcttgggtttcatagtaggatgcatttgaaggtaaaagcaatcctaacaggctgtgaaaattgcagctgccattgggggcaaccctgtaggcgtgtggtgggaggagcactagcttcagagtcctgggctgatggtagcccctcctgtgccagtgacttcctcagtggccttggccagtgttttgctcaatggggccccaggtttccctggctgagccctgggggtcacctctgattccctgggcccctttcaggtctggctgccagtccatgtgagccagcagggagggacaggccctggccctcgcccagcccagcccagcttttgtttttcatgatgcccagaagttttctggaaaatgttctgtatttcctggatgaccctgaagtggtgaccactcctgcctgcccacctcccagacccggtgccgcctgggtccgacattgcctggctttccccgcgcccttccgctgtgtcccgtgaggctctctagctttgcgctttggggtcatcttgtccagtggacgacggcgtggtgtcgtctgcaccatccctgcagtgcctgacttgtgctcgctgaacagctgtagaattacccggagctcagccctttgctgcgccctaggaggggctggaagaggagcggcctgtgtccctctgcttgtttgtggagaagctgacctggagcagtgttggaggggtccctggatcctgagcgagtgttcggtcatttgcctttccatagacctgggcgaagaagcgagaggtttgaggagtgactgaaatcaagacctgaggccgttagaagaaacaccgtttgctcagtcctttcatccagctcgcgggggacttgggtcctctcacgtggtcttgggtatgtggcctcagcggggcctggcatccctgaggtgggcagaaggttgcattggctccccagggctcagcactggcgccactgctcacataactgaagctttcttctaacagggctctcgccccgcggaacagatgctctctgtgatgtctctgagagcccagactcccagggagccttctggggaatcgaaagaaagaaaagattgcttcagtgctttggggaaaaagtgtgtgtgtacatatactgcacatagacattaaaaatcagaggctgggggctggctgcaggggctcacgcctgtaatcccagcactttgggaggctgaggcaggcggatcacttgaggtcaggagtttgaggccagcctggccaacatggcaaaaccctatctctactaaaaatccaaaaaaaaaaatagccaagtgtggtggtgcacacctgtaatcccagctgctcaggtggctgaggtgggagaatctcttgaaaccaggaggtggagttcacagtgagccaagattgcgccactgcactccaccctgggtgacagagtgagaccctgtctctaaataaattaataagtcaaataaaaaataataaattgaggctaacatattcttttttttttctttttttcgagacagagtcttgctctgtcgcccaggctggagtgtagtggcatgatcttagctcactgcaacctctgcctcctgggttcgagcaatcctccttcagcctctggagtagctgggattacaggtgtgggccaccacacccagctaacttttttttctttttttttgagacagagtctcgcactgtcatccaggctggtgtgcagtggcgcaatattggctcactgcaacctccacctcccaggtttaagcgactctcccgccaaagcctcccgagtagctgggattacaggtgcccactaccacgcccagctaatttttttttttttttttttgtatatttagtggagatgtggtttcaccatgttggccaggctggtcttgaactcctgaccttgtgatctgcctgcctcagcctccagaagtgctgggattacagatgtgactaccgtgcccggcctcagctaacttttgtattttctgttttttttttttaagtagagacagggtttcaccatgttggtcaggctggtcttgaactcttgacctcaggtgatccacctgcctcggcctctgcaagtgctgggattacaggcatgagccactgggcctggccaaggctagcatacatttaggaaatgtacagctcattaatgtgcagtttgataaatgatcacaaaatgaacatgttgagaaaaatagagcagtaccggcccccagaggccccctattgtccccttctgaacaacctgcctcccccttcttccctgggaaccacccccctgacttcctccctgggtgacttctgcttgggtttgagcttgaaagaactggaaggaggcgctcttcttgctccacctcaggatgagatgggatgcaatggccgggcggggtttgtgagcagtgagtgatctggcgtctgctgtgggaccttccagcgtcccagtgctgcccgtggacgggctccgggggagctggggacatccttgtgtctggcggtggtgcccttgagcctgatctctttgggtgcgtttttatgcctggagtggacttgttggggctgttgggtgcattcagccttcgtagattttaaacttttaggagtgaacgaatttgcatgtctgcaggcaagaacaagggtgttggtcgctctgcattcatactggcactaggtagggtgaggggtgtgtgctatttttaattttttttcaattccaccttgaatttctcattgtacttttccctgatgaccagtgaggttgagcgcctttctctatgcgaattggccatctgtttcttgtcctgctgttgaagtgccttgtgaagtcttttacacattaaaacaattgagtggccaggctcagtggctcacacctgtaatcccagcactttgggaggccgagacgggcagatcacaaggtcaggagatcgagaccatcctggctaacatggtaaaaccccgtctctactaaaaatacaaacaattagcagggcacggtggcgtgcgcctgtagtcccagctacttgggaggctgaggcaggagaatggcgtgaacctgggaggtggagcttgcagtgagtcaagattgcgccactgcacgccagcccgggcgacagagcaagactccatctcaaaaaaaaaaaaaaaaaaaaaaattgagtggccaggttcagtggctcacacctgtaattctagcactttgggaggctgaggcgggcagatcacctcaggtcaggagttgaagaccagcccggccaacatggtgaaaccccgtctctactaaaaattcaaaaattagctgggcatggtgttgggtgcctgtaatcctagctcctggggaggctgaggcaggagaatcgcttgaacctgggagatggaggttacagtgagccaagatcgcgccattgcactccagcctgagcgacagagtgagactgtctcaaagaaaaaaacaaaaaaaaaattgagttatctttttttcttactggtttataggagctctttcctaagtgctttttattatggttttaattctttggaaattggccgccttagtgccgtttatggaagctagcccaggcaagaaatggagtgtattgaaggctccgagggaagtcccagtaacctcaggggaaacggacaagtggaagctgcgggaacccagagcctctgttcggctccagcctcagcgccatcctgcagtcctgcagagcgccccagctgctccggcgtgtgtgaggccatcgccacccaccaggctggtcaagggccaagtgctgccgtcgtccctggtcccattccacaggagggagaattcggatggcccagtgtgccagtgtccaccttagggccaaccagccctgtctagggggtgggggccaccctgagggtggtggaggctgtttccagaaaaggggaggacacacccccaacaaaaaaggtgactacagcttatgccccctccgtgccccagcgtctttgcttagtcagagttgttctcagctttgtgttccgcactggaagccagagccctgtatttaatatggtatcacgtttacatatgggaggtccgaaagggacttctagccagtgtgttcacacctgccggaggctcctttgtgttaattggcattttttatcctcaggacgtcctgagtttagggtggccctctcatctcaagtttgcagttaaagaaatcaaggttgggtgtggtggctccctgtaatcccagcactttgggaggccgaggcgggtggattacgaggtcaggagtttgagaccagcctgaccaacatggtgaaactccgtctctactaaaaatacagaaaattgctgggcgtggtggcgggtgcctgtaatctcagctatttggaaggctgaggcaggagaatcacctgaacccgggaggcagaggttgcagtgagccgtgatcgtaccactgcactccagcctgggtgacagagcgagagtccgtctcaaaaaaaaaaataaataaatatctcagcccatgttgacttccccagctgggtgggggactggtagtaggcagggaagcatggtaggcccagggggatcaatgcgtgggtgatacagctgggtgggacccccagagcactcgaaggctgtggggctgccaccccctctggcctcccacctggtgggggcatcctgggacctgatcttgtgcaggtctggcccacctggggtttattggcaatgcagcagctgattttgtgagactggtaagcaggaacacctgtcctgttagaacacgaggagaattttcagcaggtggaatcagtgagctgttcggagcccctgcagacacctcgtggccttcccactcccccttcctcgggtgggaacgatggctgaggcagcccagtgaagtccacccctggtgtcccgggtccctgggccgctgtgtttcttaggaggcagacatgctgggtgtcttcattcacatcctggcttacttcccatggctgacagtgcaggctctggagtctgcccaggggtcccagtgagaatgtctctcactggttgtgtgacctgagcaggtcactcagcctcaccgggccagtttccctgactgtcaaacaccagtaacaacagcatctgctttcattcattaggtgagtgttcatccagctcttaggcatggagcggggaggtcatgaggatgcggggccgtggacagttgaggatgatgcctacttttgggctggggaggacagagggaaccaacaggtacacgagataaagcagcagtgacactatgaggagaatggcggcgggagcgttgaccacgagctggcagttggcctgcgtggtggtccaggctggcctcaccgcggcatcccaaggagggaatagcccaggccgggaaggtggggcggggtgggcagggcatgtggaatcactggtctgcagagcggggagcttggccatggccttcaggtcagggtgcagcaaccttcaccattgggcatcattaggctgggggcatctggaaggtcaggaggaagcctgggctacctaggatggaacaggcaggacagttgtctccaaggcctgcctatgacttgggcatcctgtccccagatgcacagcgtctgccccctcggtgcgggaggatgaggaacgcctgcctgtggatccacacatggtccccgtattgggggtgtggaggaaaggcctttctgacatgatctgagcccggcctctttctcttaggggtgtaccagggttggtgggtttggaggcaaatgcatttcaagggtccagatcacgaacctctgacccggtgggccctgaactctggtctgataaacatgggtcagacttctccctgaaaactgtgagcgtggagttcaggcacaggcaggcggggcaggtgctttcaggcttgatagcaagaccctactttactcatctgccctccacgctccgcggctccgacggtgtttgctgcggctcctctgctgcgttgagtccgtctgtgcactcagatggcctgtgcttcgcctttcgcccgcgttcttgggaggccttgccgcgtcccgggcctcccgcccttccaaggttggcttgtttcagtgattcggaatgtccctgttttcctctcgcagatgtctggtggcgttcattgcacactgtgtaccacaagatattgacaaggtgcaagagacacaagacgggcccagaaggcttcttggctcactctgtggcctgtatggaagggacagggctgtccccctcccctggccatccccaagacagcctctgacctgtggccttgtggttttggtttttctcagctgtagagatgacaaacgtatgtatcctcctgcctggaggcatgtgtggagagcattgaggctgttcggggaatgcctcgaggcctcccacggaagggattttgcagttttcatttctgtggctgttgtctccctgtgcaggttgcccggacacctgcaagccacccagagtccgaatccctcgggcagggaggcagtgaactgctgggctccagtccccctgggggtgacagtaaaccaggggagaaggatgcctttgttttagtggtgttcgaggactgccctgaggccctgggtccttgagtgtgttggttccacatagccgggatttccaggacaaccttgggaccctgtggcgtctgtcgggctctgtgagcccacaggaggattttcagccattctgctggggaagccccttgggtgtggttttttgtgtgtgaacagtgcccattgtcactggcgatgacaccactgactcctgtccccgtggtcccccggctgcaggaggggaggtgcccagcacagagactgagaaacaagtgggctctggagtcggggtgtgcgccccagctccaccgctgatgagcttgggggccttagccaagcttcgtttcctgtatgtttgaaagtgtgggccttgtctgcccctctttccttggggccagcgggaaagggggtgaaggcgctgacctcagcaggtgtggagggagagcctggtgggtgtggttccacctgcgttctttcacctccacagctgccttcccacttcccactcacagtctccttttctttttcctccacccccttggcagcgctgcctgctcctcttggtcctgagctggtgcacatacaaatgtacacagctcatgcacgcacacaccacatgtgtgtcattcttcttgaggcaaaggaaagggcggccccgcccctaacacttccccaggcctggtcccttcctcctgccccatcagggacctagggtctccttcccgtgtttcttctccatgtgtggatacccatgtgtgagcaataggattttttttttgttttttggagacagagtcacgctgttgcttgggctggagtgcagtggcccaggggcccaatcatagctcactgcaacctcaaattgctgggctcgcatggtccttctgcctcagcctcttgagtggctggtactacaggcacataccactgtgcctggctactttttttttttttttttttaagacagcgttttgctcttgttgccccaggctggagtgcagtggtgcagtctcggctgaccgcaacctctgcctcccaggttcaagtgattctcctgccttagcctcctgagtagatgggattacaggcacccaccaccatgcccagctaattttgcatttttagtagagacgggagtttctccatgttggtcaggctggtctcgaactcccaacctcaggtgattcgcctgcctcggcctcccaaagtgctgggattacagatgtgagccactgcgcctggccactttttgtattttttgtagagacagggtctcgccatgtcgcccaggctggtctgaaattcgtggcttcaagccatcttgcccaccttggcctcctaaagtgctgggattataggcgtgagccccctcggctggcctggattctctgtgaggtgtttccagttcttcccagttggtctcgtctcctgcaggtgtgagttgttgattgtctgcgccgtgttgatcacgtagaccctgttcttgagtgctgagggtccatccggtaaccctgcactgtcatgcatttccctgtcagcatatgacttggttccttttttttttttttttttaaaaaagaccgtcttgctctttcgcccaggctggagtgcagtggcgcgatttcagctcgctgcaacctctgcctcttgggttcgagagattctcctgtctcagcctcccgagtagtggggattacaggcatgagctaatttttgtatttttatttatttatttatttttgaaacggagtcgtcttctgtcacccaggctggagttcaatggtgtgatctccgctcacggtaaccttcgtctcctgagttcaagcgattctcctgcctcagccttctgagtagctgggattacaggcatgcaccaccacggccagctaatttgtgtgtgtgtgtgtgtgtgtgtgtgtgtgtgtgtttttagtagagatgggggtttcaccttgttgccagactggtcttaaactcctgaccttgtgatccgcccgcctcggcctcccaaagtgctgggattacaggcgtgagccaccgcacccggccctaatttttgtatttttagtagaaacagactttcccatgttggccaggctggtcttcaactcctgacggcagacctcaagtgatttgcctgccctggcctcccaaagtgctgggattacaggggtgagcaccgtgcctggtgggttataatttttaacgcttgaattttttttttttttttgttaaagggtctggctctgttgcctaggctataatgcagtggcttgatcagggttcactgcagccttgacctcccaggctcaagtgatccttccacctcagcctcccgagtaccttggactgcaagtacgcatcaccgtgctagctaattttttttgttttgttttgttttgagacagtcccactctgtcacccaggctagagtgaagtggcacaatctcagctcactgcagcctctgcctcccaagttcaagcgattctcgtgcctcagcctcctaagtagctgggactataggcacacaccaccatgcctggctaatttttgtatttttagtagagatgggatttcgccatgttggccaggctggtctcaatctcgatctcctgaccttgtgatccactcctctcggcctcccagagcactgggattataggcacgagccactgagcctggactaatttttgtatttttggcagagatggggttttgccatgttgtccaggcaggtctcgaactgctgggctcaagtgaacctcccaccttggcctcccaaagtggtaggattacaggcgtgagctactgtacccggccttgcttgatttttttttttttttttttttctgagacagagtctccctcactgcaacctccgcttcctgggttcaaggaattctcctgcctcagcccctcccaagtacctgggactacaggcgcgtgccaccacacctggctaattttttgtattttttagtagagacggggtttcaccgtgttagccaggatggtctccatctcctgacctcgtgatccacctgccttggcctcccaaagtgctgggattacacgcgtgagtcaccgcgcctggcaaaaatcttgtattgatcatattgtgtgtctgcaaccaaaatatgcgcaccaattgaaattagaattttaaataattttacatcataagctgtgagtttttcgtgttttgaatggccattactaatacccaattgatcaaacaaatattccagtttttatcaataacaagaagaaatacgaaaaaacattggaaatatgtctcttgagtagatgggttcctttttctcctggttaattcatgcattcacagttggatacaagctgttgctaaaatgatttcagcctcaatgctagttttttttgtttgtttgttttttttgagatggagtctcgctctgttgcccaggctggagtggagtgaggtggtgcaatctcggctccctgcaacctctgcctcccagatgcaagcaattctgctgtcttggcctcctgagtagttgggattacaggcatgtactaccactcccggctaatttttttttgttttgttttgtatttttagtagagatggggttttaccatgttggccaggctggtctagaactccttacctcaagtgatccacccccctcagcctcccaaagtgctgggtttacaggtgttagccaccgtgcttggacccctcaattaccagtttttttttttttttttttttgatggagtttcactcttgttgtccaggctggagtggacagctggcccaatctcagctcacggcaacctctgcctcccaggttcaagcgattttcctgcctcagcctcccaagtagctgggattacaggcacacaccaccacgcctgggtaattttgtatttttagtagagacagggtttctccattatggtcaggctggtctccaactcctgacctcaggtgatccacccaccttggcctcccaaagtgctggaattacaggtgtgagccactgcacctgggttctgttttttaagttgagaaaccttgataacatcaattagataggaattagcaagatttttatgtaacaatagcatctatttccaagttacttcacaaaaattgacataaaaacctagtacaaaaattaatgattcatcacctcacaacttacgtccttccagttaagtttttttgaggtaaaattcacttaccatggggacacctttttaaagtgtacaagtcagtgatttttggtatattcagtcatgcaaccattaccttgatctaattctagaacatggtcccagttttgtgatattacaaccattgctttaacaaacactcttcttccttgtctctaatcttttaaaaataatttttcttgttttacaaatgatatatgttaattgtagaaaacttaattttaaaaagataaaggaaaaaattaataatcacttattacctatgcaggtgttttagtttgtagcatttgtttctctgaagttatttatatgtatatatgcgtgtgcatatatatatagagtgagagttggcgggggtgggggtggtggtggggggacgggaagagagacagggtcttgctctgttgcccaggctggagtgcagtgtggtgtgatcatggcttactgcagcctcgaactcttggactcaagcgatcttcctgcctcagtgagtgtcctgagtagctaggactacaggcatgcgctgccatgcccagctaatttttaagaattttttgtagagacagcgtctccctatgttgcccaggctggtcttgaactctggggctcgagcgatcctcctgccttgatcttccaaagcgcccaggcatgaaccactggcccagcttaattactttctctgaagttattgaagcttaaaactacatacagtaagatcttagagcctccagcctagaacaccaggctgaaaagtgctgtggagaagaataaggctggaaaggggagtggaaagattggttggcaagctggggtgtgggaggcttggcaagttgtaaaaggggtgtcagaagaggcctcgtggagagagcagcctgaggtagagctggagctccagggaagagctggatgagctgaggactccagggccccgaggtgtgagtgggccggggctggcagagtggccttgtctggggcctcggaggctactgggacctgccccagtgtggctgggacgccagcagagttttgagggcagtgggtccagaaacaacagacctggggacccaggggatgtggggaggctggtgaatgggcacagtcacagggcagatggtgccagaggctctaaccagtgctgtggttgtagaaatgaaatcgaattgggagtcaggagaggagaaatgacagtcacgtagaccacgtctcagaaagactcgacgtctctttctgggtgactccttcagagtgtagtggcttagcacagtgagcacttcctaccttacggtgagggtcgggattgggagcggctccgtcggggggctctggctcaccatcactcgtgagtcctcactcaggctgtgtcacggtggctcacgcctgtaatcccagcactttgggaggcaaaggtgggaggattgcttgtgcccagcagtttgagaccagcctgggtagcatagtgagaccccatgtctacaaaaaataaacaaaaatgagccagacattgtgcacactgtgatcccagctacttgggaggctgaggcaggaggattgtttgagctcaggaggtccaaggctgcagtgatcgtgcccctgcactccaacctcggcgacagagcaagaccctgtctcaaaaaaaaaaaaagctgtgggtgggctgtggtcctctgagggcttgcctgggcatggaggggctgcctccctggctcacaggcccggcatgccggtgctgggtttagcgggaggcctcaggtcctcccctcgggacctctccatggggctgcttgggtgtcctcacagcatggtggcagcttcccccagagccttagaagccacacaccatcattttcatgcagtctctgtggtcatcatttcatgcggtcacctggtcagccctgttcagtgtgggtgcagtctgcccagagacatgtcggccgggaggtgagatgcgctgggggccctcgtggaggctggccacctcgctcatcttctgcctacagcgggggcttcttggacacaaagtggttgtgccttgaaggtgccctgggaggaggttggagcaggaggcttctggaccagggacctgtctcctgcctggggccatggagtgcccagtgcctcggcctggaaggcctggcagggacaagcccgctcctgagtgtccctccagaccaaggctgcccggccttctggaccccacctcagtacgtcagcgctggggagagcctggaagggtgggggctgatcactgctaagggtgcccccgacgatgggtcctgggctggtcagcagggtcactgggcttcccacaccctcttgccgtgctgctgtggcccttgtctgccagcagctagtgcgggggttcccagcagccgagtccttcatgtggttttcatgaacatggtgcacatcttggaggagcaggcaggtggctctgggccgggccctgtctcagccctgctccatgactggggcttgaggttggtctgaggccagcatccggagaccaccgtgccctgaggcacggggtgccttgtggcccctggccccgccccgtaggctgtgtggaaaattcacctttaaagactttgtgtatttcaatgtggtggggctatgttcaaggcccaggtaatcagggaaggcatcctgggctcactgtactgcaggtgttctttctttcttttgatttaaaaccaccacataggctttgctccacccctcgtctgctctgcaccaatttccctggcagccttgtgggcgtgtccttccagaacattctctgtgtattcacaatttgtgttgcgcacatctcagtgcgtgcggtgacccctcagaaaatgatcttgcagtgtgttaacttgttttctttaacctgcaaatactctgtgactcgctccacatcggtatgtctggatcagcttggttccagcagctgtgtggtgggccataaaatcagggcgtcccacttgctgaagcagttgccgctttcttctttgtttttggtcgtcatcagctctcagtggtccctgttctgcatgctgggttaggtggggctgcggctcccaaccactgttcctggcagtcagcagccatgctgggcacctggctctgggccacctccctcaggaggagcaccctggaatcactgttggggcccggctggtcttggtggccgtggctgtgccaactgtaactggggccgtggttctcgggaaggacacagaccatgcagcgcctgaaggtctcagaattcccgctgaaggccccgggaagggcccacctggcctcaggtgggaattctgagaaggaatagggattctggggcccccagtgggaattctgagaattcccagaagtccctgcaatacgtgaggttgaggaccatgtattctgagcatccttgaaatccacaggtccctgcagctacccgggtcctcccctcggagactcttcccgtggtcacccggctcctcctcccggggactcttcccgtggtcacccggctcctcctcccgcgggctcttcccgtggtcacccggctcctcctctcggggactcttcccgtggtcacccggctcctcctcccggggactcttcccgtggtcacccgggtcctcctcccgggggctcttcccgtggtcacccggctcctcctctcggggactcttcccgtggtcacctggctcctcctcccgggggctcttcccgtggtcacccgggggctcctcccggggctcttcccgtggtcacccgggtcctcctcccgggggctcttcccgtggtcacccgggtcctcctcccggggctcttcccgtggtcacccgggtcctcctcccgggactcttcccgtggtcacccggctcctcctcccggggactcttcccgtggtcacccgggtcctcctcccgggggctcttcccgtggtcacccggctcctcctctcggggactcttcccgtggtcacccggctcctcctcccggggctcttcccgtggtcacccgggtcctcctcccggggctcttcccgtggtcacccgggtcctcctcccggggctcttcccgtggtcacccggctcctcctctcggggactcttcccgtggtcacccggctcctcctctcggggactcttcccgtggtcacccgggtcctcctctccggggctgtgtgccaggagaaatggggctggatctgggcgtcaggtcaggaatccaggggagaggccatgctctcagtgttccttggcagggctgtgagcgcaggtctctgaggatgcccagctgtccatcccctcctcataggagaagcgcagatctcatgcctaagtgtgccagggtcctgatgggcgccacctacagcctcccgccctcacgcgggagtcagactgaacgaactagcccagatccacagagacttctaaacccggctgggtgctgccatggaaagtacacagggctcagatttgggggtaaggtgacttagcctggggtcacgaaatgtgtaaggatttcttggggtggctgtgacaaatgacctctaaccgtggcttgaaacagcagaaatgtattctctcaccatcacagaggcacacgtcagaaaccgaggtgccagcagggccacggtccccgaaggcgctgggggaggactcttccttacctctccccactcctggggccccaggcactcattgtcatccctgggcttgtggccgcatcactgcaatctcttgcctccatctcttcccttggccttcccttcaagtctgcgtccaaacctccctctcctttcttctgttaagaaccagtcactggatttagagcccctcaatccagtatgacctcctcttaacttgattacatctgcaaagaccctagatccaaataaggtcacatgcacaggtaggggctgggtgtggagtaggacccgaacttcatcggaaacacagctcaggccactacagaagaaagtggtgttggagctggatgctggctgatgggctgggagcagcgaggagccgtccagggaagggtgttgaggctggcagtgtggagaggccaggaggccaccttggaaggcccgaggccaggtggccgaggcagagggtatgaggggcacccgctggcctgtctgcatcagctcccctcaggtggagcctttctcagggccgagcttcttggccgtcagatgttcccaccaggctgtgttcagcctcagagtcgataactgtttccaggctgggcgccgtggctcatacctgtaatcccagaaccttgggaggctgaggcgggcggattacctgaggccgggcattggagaccatcctggccaatatggtgaaaccccgtctccactaagaatacaaaaatcagctgggcgtggtggtgggtgccggtaatcccagctactcgggaggctgaggcagaagaatcgcttgaacccggtgggcggagcttgcagtgagctgagatagcgccactgcactccagcctgggtggagcgccactgcactctagcctgagactctgtctcaaaaaaaaaaaaaaaaaatctataatcgtgtttccttttttaaacaggaaactactttgcttcgcactttttcatgggaggagagaaattcgacaccccccaccctgaaggttacctctttggagagaacatggatctgaacttcctgggcagccgcccggtccaggtgggtctggacagggctgtctcatggggctgtgggggtgggaggcccctgtccccagcagtccgcatcccagccatgagggcaagcaggcaccaaatcacccctaaagggggcagagctcctggcaggattccagttgagcttgggtgtgggcacgtgccctggaatgggttgtgtcctggtgctgccccctagaggccagatggccaggggcaggtcactgagaaacagagcagccatactgaatgggtgcgtctgggctgcaacggctgcggaacatggtggatttgattccagccttcttggatgactttctttacaaggcaaaaatagtatttacagactgggcattgtggctcacgcctgtaatcccagcacttggggaggctgaggcgggcagatcacctgaggtcaggagtttgagacaagcctggccaaaatggtgaaaccccgtctctactgaaaaaaaagaaaaattagccgggtgtggtggcacgtgcctgtaatcccaactactcgggaggctgaggcaggagaatcacttgaatctgagaggcggaggtggcagtgagccgagattgcaccactacactccagactgggcaacaaagggagactgtctcaaagaaaaaaaaaaaaaagaatatttactttccctagaacagtgggcaagagacatggtccaaaggagagatgcagacagctggctaacatcttcccctcgttgccagagaagggcacattcgagtactgtcatagtactcgagtactgtgagctgtctgttcagcacacatgtggcacctgctgcgtgcctagtgctcttccagggcttggggtgaaagcagaccctgcctctgctacctggtgggggcgtagacaattaatacgggacaaatgggtagaagagagaaggggcagaaagggaggctctactggagaggccatggctgaaccaagccatgataggtgggaagggggcccctccagaagaagctagaaggcagggggcctgggaacagaggaagaggtgagagggtgcaggcctcaggggacaggaggccggaagagccagtaaactttgggggccctggggcgggttgctgagctgtgctcgtaggaagctttggggatggaaagggtggggactgaggaaggggctgagggtgctcggggcagtgatggatatgggaagcctgggagagcaggttggggatgggcagccccagcgtgcaggggtctggcgttgaggctgcctggctggatttgctcagggtgatttggtcctggccgttgcgtgtgctggctgcgtggcctgcagcttctacctgtaaatgagaacagtgcacccagtatagcccctcccatgggactagatcccagggataccctctggggctgtggctgctgcaccctgacccgttttctgttgttggctgctcctgagggagtcacctggggccctgtggtttttctcctagtttccctacgtcactcctgccccccacgagcccgtgaagacgctgcggagcctggtgaacatccgcaaagactccctgcggctggtgaggtaacttcaccctgcccctggggaccctgtggctctgtggggcgcagcctgtggtggaggttctggcttgatgcttgaggaaaagggcaggcgggaggggccccagtttctgcgccctcccgtgtggaatgagaggctgtcctgggctgagcgagggaaagggcatgtggaacaagagccgtttagccagggcttctcagctgtgccgcacagggaccctgggcagtgtctggaggcagccaggtggggtgcttggcatctcaggtgggtgccaggggtgctgcagacttcctgccatgcacaggacggcccccccacagacaggaatgacccagcaccagatttcagcaggttcagaaactgcttaaaccgactagacttgaggcatctggggctgtctctgaaccaaaagcacgtaccccgtcttctgtgggcaggaagaaggagaggcaagccctggaccactgggctttcatgtacaaataggaaacagcccctatgtctactggagaagcgggctgtgtccacatagccacctccacggcccctcagcctggcaggggaggaggcagcctccgcagatggggccgctgacccgctgcctttctctccaccgcctggggtaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtgtgagtcccgcgggcggctggcaccggcctggctgggggccccagactcctgggggaggcttctgtccaccttactaaccagagggagaaaaccaaaccgtgctctttgaccatactcccaggactttaccacgatgtgaggggtttctcccaccccagggactccccacttttctgcgggaaccagctggggtcctttgactggtttcagttccaacgctgcctggaggtcatgcaacccctgcactttgagggcccagtcccacaagactgccccacttcagatgccactcataagcccccgctgtcacctgaacttctcagcaaccagccataaatcaggctcccacagtcccctcctcaggcttgatgagttgctagtgtggctcacagaacccagggaaacacttggctggtgtttgttggtttattgtaaaggattcagatgaagaggttcacagggtgaggtgtgggggaaggggtggggcgcaccaccttcctcgtattcagcaaaccagaagctctcctgaaaaccccatttcagggccttttctggaggcttcatcacgtaggcaggattgatgattaactccatctccagcccctgtcccctccctggaggatggggctgggctgaaattcagttccaggtttttgttttgtttttgttttgttttgttttgagacgaagcctcactctgctgcccaggctggcgtgcagtggcacaatcttggctcactgcaacctccgcctcccgagttgaagcaattctcctgcctcagcctcctgagtagctgggactacaggcacgtgccaccacgcttggctaatttttgtatttttagtagagatgggggtttcgccatgttggccaggatggtctcaatctcttgacctcatgatctgtccatctcagcctcccaaagtggtttttgtttgtttttgagacagagtttcgctcttgttgcccaggctggagtgcaatggtgtgatcttggctcactgcaacctccgcctcctaggttcaagtgcttctcctgcctcagcctcccgagtagctgggattacaggcatatgctaccatgcctggctaattttgtatttttagtagagacggggtttcatcatgttggtcaggctggtctcaatcgctcgacctcaggtgatccacctgcctcggcctcccaaagtgctgagattacagccgtgagcccccatgcccggcccacctggcccaggtttttgtttgtttttcctcgggagctcttagacgacacttccaagtctctaatcatggcttggtctttctggcagccagccacctccaggagccaagagtcacctcactggcacataagacactcctaccacccgggaaattccaagggtttggagttctgtgttgggagcaaaggtcaaggaacaaatattagaacaaaagaggctcctagcacccctgttgctgaggaaatgacaagggttttagaggactctgtgtcaggaactggggctgggaccaaatatttattttttattgtgtcataattagatatttgtactttcagaggttttatttgagataagggtccttctggccctgaaagtttgaaaactgcaacttcagcaggagctggcaggactgcctccaggctacaagggcacatgtgccccaagtggctttagagacaggcaagagcgtgccccctgccttcctgcactggagcacaccgctcagtggtcagctttgcatctggggatagggtgtggttgagagcctaggctttgaatgctgtccccgctgagtggcttgggggcacatgactgcttgtgcctctgtgtcctcagctggaagttcgggtgggtggtgtgaggaggggaccatgtgtcctgtgcacagcccctcgcgtgacaggtgctcttgaaaggagcctgagtgctcgagttgaggggctggtggagacgacttatgtggggaggttcttagggacctgccaccaggtgaggccgcccttgggctctggccttgggctccccggcagccagggctcctcctgtggagcagcactttggggaggaacaggttcctttttctagactttgttctttgaggctctaccttgccccggcacttgattatatttctttaatgacactagtaatgcatgcctgtgtgctatgacaggcgtcgaattcttgggcgtaggagcatttggagtgaccagggcaggcccctctgtcccctccttgcaccccactgcttggggttgagtgtttgacacccacggggcctggtgccctcctcgggcctggccgacatggtggaggagctgggttgtggcgaggtgtccaggggctgccacagagagggtgtgggctgaggacacaggccagtgtaagttgtctatccgctgccccccagtgctccagctgtcaggggctgggtgaccatctcaagtgcacttgaagagagggtcccgctgctaccagaaaggctagagagagcagagagggtgccctgccagccctggctggtgtcaccctctcctagacccctgcgggctagtgatgagagaaatgccacagtccccccctctcaggacctggcacaaggccagcttcccctcccagcaggaatcacagagcaggaacagctccagtgccactgtccccctctgtcaggacctggtacgaggcctgcttcccctcccagcggggatcacagagcaggaacagctccagtgccactgtccccctctctcaggacctggtacgaggcctgcttcccctcccagcaggcatcacagagcaggaacagctccagtgccactgtccccctctctcaggacgcggtgcaaggccagcttcccctcccagcagggatcacagaaaaggacctggaggctccaggacctggaggctgtgcccaggcacccggacaccatccagcctgccagtgctccatccatttgagctgcagggcaagccaccctccctgcctcctgacaaggaaactgaggctcagacagaggggtgtgtccaggcctccgcatctcacaggagaaggctggggtccacctgagggtggcgtcttaactgtgccttttactgaggctgagcccgggcctcccctgtagtgcctccaaccatgctgggctctggcggccatggcaggcctcttctgcctttgtgtgtacagtggtggcccccccacgccccatcccatttctgagcttggtgtgcctttgtccaggagagcctgtggagccctggccacaggcaagcagggcggtggggtggaggggaggggctgtggattgtgaattgggttcctgcatggagttttatcagaaatgaaactgcttgaggcacctgtcttagggatgcactcgtgcctgtggctaagacatgcagaagggcggtccttgaagcagtgttgggaaaagtgagatgttggtgaccatctgctggtgtcccccaggggccctgactgaatcagtaaaaccaaagcgggacctgtgtggtggttcacaggacacagcccctgatgtgtgcagacgcatgaaagagcagtgttgacgcctaccccgtctgaacgttgaggaagagagacccgcgctgcatgtgggcaccattgtgcctccgccttccgggagtgatctgtgggtctctgctggggcggacagcaggcctctgggagcaggcgtgagggttggggaagatgcattttgcactgtgtatacttaagtactgtgttcatttaaaaagtaaactcaagctgggtgcagtgactcaggcctgtaatcccagcactttgggaggctgaggcaggtgcatcacttgaggtcaggagttcgagaccagcttggccaacatggtgaaaccccatctgtactaaaaataaaatattagcctagcatggtggcgcacacctgtaatcctagctacttgggaagctgaggcaggaggatcacttgaactcagaaggcagaggttgcagtgagctgagatcacaacactgcactccagcccaggcgacagagcgagactcttatctcaaaaataaataaataaataaataaataaataaataaataaataaataaacaaaccaacttagcaccgatggaaaggaaaagcacagctacactggggaggtatcaaagggattgggcaggtgtgggctctgggagaattgtagccaggcctgacctggggagagctgcatggtgagcagagaggccgtggaaggccctggaagggtgagggccacgtggccatgtaggctgtttgctgttccccatgagagagggtccccaaaagacaggtgtctgcggcccttccagctgtcggagtgggagggacgggcacggagggccctcttcctgccgcagcctcactgcttgctcctggctccctgcagatacagccccaagagcccctcgctacagtccgagaccgtccactacaagagaggggtgagccagcagttctccctgccctccttcaagattgacttctcggaatggaaggatgacgaggtaatgctggctgggcggctccttgcccttcgctcctcctgaattctctccccttgggggtggggccagcacagtggggtctgtgtgtttggcttcctccagggttcataagacctgggaacggccgccccagtctgtgctcaggtggacgtgtggatgggcgggagcaaggcctgggccatgtgctgatggggccaggggaccagaggccgaccaggcagccgcactcggaggctcagacactggggtttggggagatgtgaagaatggggcaccccctgccaggctgcagcaatgcagggtctgttcacaccaggtggcattccttcaagctttttaaccttacttttgtttaaaatcttggtgcagacatcctttttttttttttttttttttttttttgagacagtctcgctctgtcgcccaggctgcagtgcagtggcgcgatctcggatcactacaacctctgcctcctgggttcacagcattctgcctcagcctcccgagtggctgggactacaggcgcctgccaccacgcccggctaattttttgtatttttagtagagacggggtttcaccgtgttagccaggatggtcttgatctcctgaccttgtgatccgccggcctcggcctcccaaagtgctgggattacaggtgtgagccaccgtgcccggccattgctgcagacctcttttaaccaggtcttttgtaggttgcggcttgagtggctgctttgctagttgctcctcctaggcccctctccagcttttagtcaaagctgtgtcctccctccttccccctttgccttgttttccagcgtccatctggtctgcagcttgcaaagaccctggtccagggggttcctgtgtaacagtacagaccttgtgtggccgggcgcggtggctcatgcctgtaatcccagcactttgggaggccgaggcaggcggatcacgaggtcaggagatcaagaccatcctggctaacacggtgaaaccccgtctctactaaaaatacaaaaaaattacccgggtgtggtggcgggcgcctgtagtcccacctactggggaggctgaggcaggagaatatcatgaatccaggaggtggagcttgcagtgagccgagatcacgccactgcactccagcctgggcgacagagtgagattccgtctcagaaaaaaaaaaaacaatgtagaccttgtgggtcccaggtctgaggccaggaggagacactgaccacatgccctgctagcaggcctcatgagctgacttacgctggggccagtcctgtggctgtgttcctgacgtttagccactctctgtaaaaagcctcccttgtccttgcattaaaaataaaacaagccaggtgtggtggctctcgcctgtaatcccagcacttcgggaggctgaggtggaaggatcatttgaggccaggagtctgagacaagcctgagtaaaaccttgtctctatgaaaaatacaaaaattagctggatgtggtggtatttgcctgtagtcccagctactgaggaggctgaggtgggaagatcgcctgagcctgggagatggaggctgcagtgagccatgatcgtgccagcgcacttcagcctgggtgacagagcgagaccctgtctcaaaagtaagactacctgggagtgggggaccaccaggttgtctaaggaggggtgaaaaccgaacagatcaaaactcccatgctgatcagtagtgggattgtaccttggaatagccactgcagtccagtctgagccacatagcgagactccatttcttaggaaggtaaaaaaaaaataaaaataaaaataaaataaaagtaaaataaacgtctccccagactccctcgggtgggtggagtctctgtcctctcccggcatcactggcgtggaccctgcaccctgctctcacgtgtgactgtgggtgctgtgtggcgtgtgtgctgagctctggggagtgggagtttgggaggtgtctgtgtttcctgtttgtttcatgtttcctggggtccctccccagcccctctggggagccccagtctccgagccctgtgagccatgggtttgcaggtgaggtggccggggtaggggagtggtcattgtggccagcttcctgaggggtacggtgtttagggcccagagagggttggaatcacgatgcccccagttgtccttacctctgtcccggacttggcactggacccgccagggggcctttggtgagggtttgctgaggaagctgaaggagggcccgcgtgcagcatagtgctggctcgtctgtggatggccacgctgagttggcgcacataaggggcagctgctgctgcggggccttcaaggtgctatccttgtcaggacttttgtggatgcaagtgacagaaaaacatttggtctggtttaagaaaagaaaaccagagacttactggtgtagattcagagaaggctgggtggcctgagatttcttccagggcctgtgtcatcagggtggggatctctgtggcttagcctcccatctccctcagctggccctgctccagcgcgtggccatccggctgggtccggagatgcttggaggccgtgtgtcttctctttgtggccccatttggggcgggggcctcccgtcctgcagccaggccgcagagacctggagtaggagggagacgcttccccgaagagaacctgaggggctcagatgctgggccaggcatggcttagcatcaagagcgcagctgcaaggacaggccacaggggtgcccagcatggctgcactggccttgcccaggagcagagaggacatgtgtggaggggctgggggcccactttcgttctgccgctttttctctctagagtgttaggccagttctgcagctctgtgagcctgggtttgcccctctgtagactggggctggaagcagtccctcgcagggtggccacgaggggtccgtgatcagcatgcaaagggctttacctggagccgcccactgtaaacccgtctgccagccggggagtgggagagaaggctatagccaccatcttgcacgcctccccagaccgttggtttttattccacaccagtaaagcactgtcagcacctagtttctgcagtgtgatgagaaaaaaaatcacagctcactcagaggctcctcagagcacagagcggcccacgccagtgctgaggtgctggctgcgcggatgcattccaggcctgggcagaagcgaaggggtgggcaggggcgcgggggtggatgcgctccagaaagctctgcctcccccgtttggctccatcacctaaaggagtggctgccggtgcgcgaactccccatttccgggcttcatgacagcccttgtggcagcagtgtgggagcgttgccaggcaaccctgggacgatgactcctgtgtggactcagtggagtgggcaggaaacaggctcacaaggggcctacagtcccagcatgatcagccctgacaggccccccagaccggggaagggagtgtccctcactctggcaagcccaggtgtctgtggtatccctcagacggctgggagctggaggcctagctgggtcccagtgggtgtgaacatgtgccccacgtccctgcagccttttatttttccccctttttttgagacaggggctcactctgtctcccaggctggagtgcagtggcacaatcacagcttgccgcagcctcgaactcctgggttaagcgatcctctcacctcaactttcacagtagctgggactacaggtgccacaactactggctgatttttttttttttttggtagagacagagtttctctatgttgcgtaggctggtctcaaactcccgggctccagcaatcctcgtacctcggcctcccagagtgttgggattataggcgtgagccaccacgtcaggcccaccagtctgcagctttctgatgtgtgtggacgttttcacaaagccgtggcccaggattggccgccttggccacctttcgcacccttttctcctgcaccctccagccctctcccggaggaggctgggtcggctcctgttgcctggacacacagggcttcagggtgctggtgttgactgtgtgttctgccagccacagcacttggagctttgtgttaggcacggcttccgttccattttgccaaatggggaaactgaggctcaggtggggttctaattgtagtgaatgggtgaggagctagacttgatgccggcagccttgactctggccctgggccagtgccctgccagctcctggctccacccttcctcactaacagagaccacggcacttctcagccttcacagcatagcccccagcatcagtgtctctgtccacctctgtccatgtgtgcgttgttgtccatcccatgggacttgtggctggaacccctgacccttcctcgtgagatgcggggcctaggtccgtgtggacttggtctccaggcttgtggtttgttcagcagatggctgcctgcccagggcttcttgtgtggatgggttacgtgtgccattcattctggtctgaatggaactcttagctccagatggcaggaagctgcggtagccgtgtgccaggtgcctgtgggtatggagtccctgctgggtggggacatgcctgggaacgccagggtgctgccagcctttgccgtgtgtccatgtccacatagcctccctggttcgcagtcgggtactttcttgacactgatgtttgtccccgtccccttctcctgactgctgtctgtggtccgctgtaactcctttcttctcgtctgtatttttggtaggaaattcgctgtgttgacaaatgttaggaagaaacatttccctcggttccttaaataatagtaatatttggccgggcgcggtggctgacacctgtaatcccagcatttttggaggctgagttagtcggatcactggcggtcaggagttcgagaccagcttggccaacatggtgaaaccccgtctctactaaaaatacaaaaatttagctgggcgtggtggcgggcgcctataatcccagttacttgggaggctgaggcaggagaattgcttgaacccagggggtggaggttgcagcgagccgacatcctgccactgcactccatcctgggtaacagatcaagactctgtctcaaaaaaaaaaaaaaatcataatagtaatactcacaacaactgtagcagccaccacaggcagtgtctctgtgctgggtctgtcgagaggacttcatttgcgctttatccttgaaacccatgcggtagcgtggtattgaccccattttacaaggaaagaagccgaggctcggagggaggagggcctgagatgaaagccaccctggtcactggggtggggacgtgtgcccctgccctgcttccgctgcccacttcacggggggacagcaggggagaggagacatcctatgtgtctgttggttctgagcattgctgttcaggggcgggtgcttggctgcgggctcagggttcccttgtgctgggccaggagtagtcccacctggacatccgtgggggtggttgctgcagacatggaggggcttgtcccttcctcatgggtcttagtcagtgaggcctgtggtcggtcttgggaggcaggaggctctcccctcacccaactgcccttgcctgggctgggcctgccaggcctttcctatttgatgtttcatccatattttgtttttgtttttgagacggagtctcactgtgtcgcccaggctggagtgcagtggtgtgatctcggctcactgcaatctccgcctcccgatttcaagtgattctcctacctcagcctcccgagtagctgggattacaggcatgcgtcaccatgcttggctaatttttgtatttttagtagagacagggtttcaccatattggccaggctggtctcaaactgctgacctcaggtgatccgccacctaggcctcccaaagtgctgggattacaggcgggagccacggcacctggccttgttttttttttttttttttttttttttacacctttattgtgttataattaccatctcctgcagctcactcgtgttaagcgaatgattcgctggcttttagaatgctcacagtggcacagccagcatctgttctttcagtaaatcttcattgagaaataaatgattctttttcttcccagaataaacagatgcatgtgtccattgctgttctgtgccagacaccgaggatgtcatggtgactggagaggcagggtccctgccctctatggagggagtcagggagcctgatggtggccggtggctttcctggttgccagggtatgagcaatagaagcccaggggcgaagtgcttcctgaggcccagagaaggacgtggcctgtagagagtagggcgagacccacagagcagtgctggggagcaggggtctgagaggatggcactgtgctgggctgactgctggggccctgggggccgtggggaagagggtggccttcagcctgtgcacagcagggggtgggatgaacgcaagaggaagcttctctttggactcaagccagcctcgtggtctcccttgcttgccttttgtgtttgctggggccaagtccggtgccttcttcagaaagttacagggagttgcccagtgaccagcacttcccctcagaggcacgcacccgggagaactgaaaacgcggttcaggcagacacttgcgcaccggtgtccagtgcagcgctgctcaccgtagccaggacacaggcccagcccggtgtccgtcgcaaaggaacgcgtgcacagcgtgtggatatccacacagtgcctgttatttggccagaaaaaggaaagcagcaccgatgcgtgctgcaccgtgggtgaactttggaaacatacctagacacagaaggtcacctgttgtgcaattccatgtaaatgacaggtccaaaaatggcaaatccctggagacaggaagcacatggtggctgccgggggctggaggaggggatggggagtgtgtgggtgctgatggctacgtgtggggtttccgtttggggtgatgaaaagttctggaaatggatggtggcggttgcatgacattatagatgtactttactcaacgctgttgaaacgtagttaaaatggcagattttgtgttgtatctgttttaacacacacataaaaaaggtgccaagcctggcatccgccttccctgccatctcgaggcgtgtcctctgagctctgctgctgcctcctgctcctgcctgctttgtccagctcatttgttgaccgactccaggcttccaggcttggctgtgtgggtcctgaccattcttggcaactctctcctcagctgaactttgacctggaccggggcgtgtttccagtagtcatccaggctgtggtggacgaaggagatggtgagtgcgtcctcttccgtcctcctgggcgtgcaggccgtgcagggaggaagcacgtcttgagggaggagtgcttgcagcagtgatgaagcaggccaggcatagggccttgggcttcccacagggcagggtgtgagcagcttggagtcccgggcaggtgaggaggtggaaagtgcaggagggcaggtcccagaacaggctcaggactctatggactctgtgcaggctgagccctcggtgccgcaggcctaccagggtcggggaggtgagatgcctgggtggggcaggccccgactctgactactctgcccctctctccccagcagtggtggaagtgactggccacgcccacgtgctcttggctgcctttgaaaaggtaagtgccatctggccatcactttcccggggacctgggagctgggcagggggtggccttttgagacgagaagcctgagcaggggctggggcttggtggggtggctgagtgtcaagggccccggggcaggttggggcgtgtctgtggcttcctgctttctagcattctggtcctgaggccgagtgccgctgtcaggaggcttagcatttcctttttttttttttttctttcctgagccgggctcactctgtcacccaggctggagttcagtggcgtgatctctctcggctcactgcaacctctgcctcctgggttcaagcgattctcccacctcaacctcccgagtacctgggagtacaggtgtgcactaccacgcctggctaatttttgtatgtttagtagaaacagcgtttcatcatgttggccagactggtctcaaactcctgacctcaagtgatccacctgccacggcctcccagagtgttgggagtacaggcgtgagccacgtgcccggccttttttttttttttttttttgaggcggagtctcaccctgtcatccaggctggagtgcagtggtgggatctgtgttcactgcaacctctgcctcccaggttcaagcgattctcctgcctcagcctccaagtacctgggattacaggcccatgccaccatgcctggccaattttttttttttgagacagagtctcgctcttttgcccaggctggagtgcagtggcatgatcttgtctcactgcagcctacgcctcccgggttcatgccattctcctccctcagcctcccaagcagctggtactacagatgcccgccaccatgcccagctaatttttttgtattttcagtagagacagggtttcactgtgctagccaggatggtctcgatctcctgcctcttgatccacctgcctcggcctcccaaagtgcttggattacaggtgtgagccaccacacctggccatctcttttcttttttttaaacagggtctcgctctgttgcccaggctagagggctgtggtgtgatctcagctcgctgcagccttgacctcctgggcttaaggagatcctcccacttcagcctcccgagtagctgggactataggcatgcaccaccacgtctgtctaacttaaaaaaatttttttgtagagaagaggtctcgctatgttgcccaggctggtctcaaactcctggcctcaagtgatcctcccaccttggccttccaaagtgctgggattacaagcgtgagccaccgtacctggccaagaggcttttcaaagggtacttggagtgtgttgagggagaacattgtagactgaggccagccctgtagaattctgtagagcctgctgccatgccacgggctggggctcccacaaggagggctgtctgcggtagactgccttcgccctggggtgtgcagagatcagcaatgttgttacctcctcgggctgtagctttttcctaccaggctcagtgtccttgggtgtcacctggcacatgtcacagacccccagtcctgctgctccttccgccacctgcctgcggcactctgaccctgcaggctgggcaggccctgcttcctacaggagccttttcctgacaccactcaggacaaacatctgttgttcccacttgatgttcacgagggcagcactgtcctcttgggtgtcttggcatccccagagctgagtttgatgtctggcacagagcagacactcagaacactggcaggatggacgaggggttgctgcccacctggcatgggtttctgctgagaacctggcggaggtggtgggacgcacgcttgtttgatagtgccttggtgcctcggtggccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgggtcctgcctagcccaggctctccacccacctccagccccatgtgcagccgcagcccctgagagctctaagtgcagagtccagctcttacctgtgatctgggtctttctagagcaccccagggtcgggggttctgttagctgggtagaggaccctctcctctgtgtgtcctgtggcgaggctgggtctgttctctcccgggtccaggaccacagactgtggtgacacaagtgccctgggcagagggcagccttctgcctttttagtactgggctccccagctgctctccccggcccggactcgtcagaagccacggtgactattgacacatctgcatcctctggcagaggcagatgggacatctctggcaaaatggtctattctgtgcttgaagtacagaacccagtgggaaactgctttatttttggagtccaacattctggaaatttctgttagaacccaccagcctcactggaaaattctgagtgctgatggtggttgactgagaagggataatgagtgttgttgcgaggtctccgatctcaagccgtaattaaccttgttgaactctgagcggtggtgtgtttccctggataccgccgggtgtgcttgttctatttcgttcctgcgtttttagagctttgcggttccctgtgtgtgcaccactgtgcgtgctcccgctctgtctttctaactcagccgggcctgggagagcaggaagctgttttgtctgtcttgattcttgctgccaggtgatacttctcggtgtgcaggaggcccttgtccatcatctgaacttggctgattggcattcagcttgagtgtgcttgagaccaaccgaggagagttgggttctgtgggtcagcagagggtccccgggctgtgtgttctggaggcctcagatagttgcacagccaggcctgaggccgtgttttcagaaatcccggctctttcgctgtcaagtggccccacccttttttttttttttcttttttctttttccagctgtgggcatggattggctggggcagggtggccaacccaggcggccacgcaggggtgctcagaggcgccagcttgaccaccttaacctctttgtctttctcccctgcagcacatggacggcagcttctctgtgaagcctttaaagcagaagcaaattgtaagtcatcagaggaaatatgacgtgcttgaattaaaagacacacatatacaatcactcacacgcatactcatacatagacacacactcatacacacgcacatatactcatacacgctcatacacactcatacacattcacttgcacatatatacggacacacatacataccatcagacactcacattcacacatatatagacacataaacacacagacacacacatacacacataaacacactcctactcgcacacactcatacagacacgacactcatacacacatacactcacactcacatgcagtcattcagatgcacacactcagacacactcatatactcagtcacacacatatacatagacacactcgtacacatacacacatacactcacactcactcacatatacatagacacatactgatacacacacatatacccattcacacacacatagacattcatacacatatacacatacacacacgtatacagacacacactcatacacatacccacacatatactcacacacataaactcacatgtatactcatacacatatacatagacacacattcactcgcacacatatacagacatacatacacacaatcacttgcacacatatacatagacacactcatacaatcactcacgcacatatacaaagacgcatacactcacatagacacacacacatacacatatgtacagacacacatatactcacacacacttatatatagacacacacacacactcttcagtagtcttcatgcactggtcttcctaggctacccttgctgctgcctttgaaataactgtgcaggggctgggcgcagtggctaacgcctgtaatcccagcacttcgggaggccgaggtgggcagatcacttgagcccaggagtttgatatcagcttggccaacatggtgagaccccgtctctactaaaaataaaaaaattaaccgggtataataacacatgcctgtaatctcagcaactcaggaggatgaggtaggagaatggcttgaacccaggaggtggaggttgcagtgagccgagatcatgccactgcactccagcctgggtgacagaggaagactgtgtcaaaaaaaaaaaaaaaaagctgtgcaacagcctgttgacttccctgtagagctctaagctctgggacgacgggtccctgtcttgggtgagcatatatgttttgcgtgcccgccatgtacagggacgcctgcaggccctgagttctgtccagtttgagccattgtgtctggaacatagtgttaagtaaatatttgccgaatggatggatggaaaaggaaggaaagagaccagaaacaaagtctgcaactccttctcctcttccttacaaattgtccaatatgtcagtattggacagagacttagcttgacttcatcaatacttgaaaagaaggattaaatagttgagaataaatggagctatagagcagtacatctgttctctggggtcagcgatcctgggatgctgcattgggaagtgttattcctggtggcctcacaagtaggcaccgagaatttagaggatggggtgccctaaacagcagtgttagatcttgctaatgagatgtcctaggccacagctaacagttactccgtgtgtactgttggggcgcataagacctgtttcaagccaccacttgggaatgatttttgttagtttttaattttttaaatatttaatttaattttaattttaattttattttattgagacaagacagagtctcgctctgttgcccaggctggaatgcagtggcgcgatctcagctcacttcaacctctgtctcccaggttcaagtgatttctcgttcaggctcccaagtagctgggactgcaggtgtgcgccaccacagttggttaatttgttttgttttattttgttttgtatttttgagatggagtctcactctgtcgccgaggctggagtgcagtggcatgatcccagcttactgtagcctccacctcctgggttcaagtgattcttctgcctcagcatcccgagtagctgggactacaggcacgcgccaccatgcctggctaatttttgtattttttgtagagatgaggttttgccatgttggccaagctggtctcaaacttttgggctcaagtgatccaccagcctcggcctcctactaaagtgctgggatgataggtgtaagccactgcacccggccatctgttagctttttagaagagagtttgtccaggtgcagtggcttatgcctatgatcccagcactatgggaggtggaggcaggaggattgcttgagcctggggattccagaccagcctgggcaatgtagcgagatcctgtctatttaaaatgtaaatcacaataaacaaaagagaggtgcagcaaactctagcaggtccaggtccctgcaggtaccaggggaacaggagaccccagtgatggtcagggccttgtgttgagagagctgaccagcaggccctgggctccctggagtggtgctcctggcccatggtctctgggaaacccagcagcacaaaccgctttgcaatgtggtcagcgtgaggctttttggttgcaagtgggtggcaggacagaatcagcttggagacattgctttggcgtctttgaaaccagagaggcttcatgccttttggaaggaggatctggaaagcagtgggaacttaggctgctgtctggtgccttcaggcgtcagctcctgctttcctcgtggggctggtggtggtggagccaagtggtgttgggggtggtgaggcggtcagggggtggtggttgggcctgtgggttggcttcaggcccccagtagtggggagagccaccggctccagccctgttccaggtgctgctggttgggtgggggcaagcagcaggttttccctgcccttctcctggcccccaggggttgagctggactgacccctggtatggaagcctggtaagttggaggcagggctaggccaggtgggtatggaggagccctcatatggcagttggcgagggcccagtgagcccctctctgctctccaggtggaccgggtcagctacctcctgcaggagatctatggcattgagaacaagaacaaccaggagaccaaggtgtgtatctgggtgaggtttccctctgccattacagaagcccacaccaggagcagccgcggacagcaatgcttgccggttcccttccatgccttcccctggagtcctagacccgctagacaacatcatttttccttaattttttttaaagctaacagtttagggaacattttatcctttctccagcaaattcactagcttctgatgtaaattgccatccaggttccccagggcagcccaggaatgggggccagtgtctcaccctctaggctcaggtgtgtggcaccctgctgcccggctcctgcccgcctccccagagacagcacgtccctgcagctcctgggggagggatgcttattctgtatgtccatagaaccagtcctggtgcctgacaaataagccgtggtgtaccccagtcagggaatgtagcaggggatgaaattagttttttttgtttttgttttttgagtcagtctcactctgctgctcaggctgtaatgcagcagggagatcttggctcactgtggcctccgcctcccgggttcaagcgattctcctgcctcagcctcctgagtagctgggaccacaggcacgcgccaccacacccggctaattttttgtattttagtagcgacggggtttcaccatgttggccaggatggtcttgatctcctgaccttgtgatccaccctcctcggcctcccaaagtgctgggattacaggcgtgaaccaccgcgcccagcctaatttttaatttttgtatttttagtagagatggggtttcactatgttggccaggctggtctcaaacttctgatctcaagtgatctgcctgcctcagcctcccaaagtgctgggatttcaggcctgagaccaccacgcctggtcgatgaacttgttaaaaggcacactgacatgagtgaaactcctgcctcttaagatctcttggaaagtctcacaggcccgcttcattatggcatctgggcccaggacaactggagcagctccacgtggcgggagcggagcacctggccgggcctcgcctcaacccagggaagtcagtgcattcatgtttcataccagggggcggcccactttgagaaaaggttcagagagggaatgttttcagccgcccgggcatatggtctctgttgcactgactccacgctgccattacaacaggagcagcggggactgtataaaaatgagtgggtgtggcggtgttccagtaagattttatttatagaaacaggccacaggcctagtttgtggacacctgttttagatttttggctttctttttgtccagttgctaatgtggtttctggtagctgccattaatgaaaatacttctaacatattaacttgttttttgttttttttgtttgtttgttttgagatggagtcttgctctgttgcccaggctggagtgcagtggcagccatcttggcccactgcaagctccgcctcctgggttcacgccattctcctgcctcagcctcctgagtagctggaactacaagcacgtgccaccatgcccggctaattttttgtatttttagtagagacggggtttcactatgttagccaggatggtctcgatctcctgacctcgtgatctgcccgcctcagcctcccaaagtgctgggattacaggcgtgagccaccgcgcctgaccattaacttggttttttttaaaccaaagataacgggtaccctgaccctcaggaagatgtgtttcttaggtgcatctgttcctcattttttctttaggtctgaagaacagaaagagaccatgttctcatgatttgggtgggtgaggggcacagaccctccccctctgccaggtgctgagtttgcactggatttgagcctggtgattctgctctggggcaacctccccctcccctctggacttctctttgtcatgacagcccccagggtagggtggagtggggtgggacagctggggacaggaagcaggagccgtactctggcctttgggaggctgctgacccacaagcccttgtcccggcagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcgtgagttccccggccggctgttctgtggaaggttctggaaattagggactggccacaccacggtggtcctgggatagggggccacaggtccgttgatggctaagaaagaagagttgtcattcatctagtctgtgctgaacgtgggcgtgttggctgtcggagtcagtcaccgtgagagagctggcagggacgctagcacggggcattcagatcttcacgtctgcctccagccaggcaaggcttgcagaacaaagggctacagaggcgctccagggcagatgaactgaacgaaaattgatgagtgaatgaaatctttattcttattttatttttattattttttgtttgagacagtttcgtgctgtcgcccaggctggagttcagtagcgagttctcagcttactgtaacctctgcctcctgagttcaagcaattctcctgtctcagcctccctagtagctgggattgcaggcaactgccaccatggccagctaatattttacttttattagagatggggttttgccatgttggccaggctggtcttgaactcctggcctcaagtaatctgcctgcctcagcctctcaaagtgctggtgttacaggcatgagccaccatgcctggctattttattttattttatttttttgagatagagtctcgctctgtcacccaggctggagtgcagtgttgcagtctcggctcactgcaaactccgcctcccgggtttaagtgattctcctgcctcagcctcctgagtagatgggattacagccctgcaccaccatgcctggctaatttttgtgttttaagtggagatggggtttcaccatgttggtcaggctggtctggaactcctgacctcgtgatctgccctcctgggcctcccaaagtgctggaattacaagcgtgagccaccgcttttttttttttcttttcttttctttttttttcttttcttttcttttctttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccgagccaccgctttttaattaattacttacttttatttatttatttattttgagacagagtcttaactctgttgcctaggctggagtacagtggcaggatcttggctcactgtaacctctgcctcccaggttcaaatgattcttgtgactcagcctcctgagttgctgggattacaggcatgtgccaccatgcccggctattttgtgtatttttagtagagatggggttttacattgttgcccagtctggtctgaagctcctgacctcaagtgatctgcctgccttggcctcccaaagtgctgggattacaggcagagccacagggccctgccttgtttttaaaattttttttgtagagacagggtcttgctatgttgcccagcctggtctcgaactcttggggttaagtggtcctcgtgcctcctaaagtgttgggattatgggcatgagccaccatggccagctcagatctttattttaaaggtaaaatagaaaatatttcaataaatttttagcataacgctggttgcagatcacacctataatcccagcactttgggaggtcaaggcaggaggatcgcttgagcccaagagttcgagactagcctgggcaacatggcgaaaccccatctgtacaaaaagttaaaagttagccagatgtgttggctatagtaccagtgacttggaaggctgaggcgggaggatcggctgagcctgggaggttgagggtgcagtgagctgtgattgtgccaccactgcacccccgcctgagagacaggggaagaccctgtttcaaaaaaaaaaaaaaaaattatagcgaagtgaaaacaaagtatgctgggtagaaaattgaccaaggaattaaattgggttttctagagcattccagacatttcctcagtgaaaagccgctcgtagggccccgttctgagtgtcttccagtagagggaacaacctgaatgttctcagggtgaaaaaacgaccaggtcaaagtgcacatcccactggtaggcccttgccctggatcctgggatccctggcctgggtcctggcggtggggccggagcatagttggggatttgcctgcgcagctgcaggacacatgcgcttagtaggccagcagacctccaagccgggcgtggggctgtgcgaggatgctggtctgtgcagtcaggccatggggtcactggatgtgtccagatcccaggagtaagtgaagaggctgctggggcctggagggagaggccggccgcccagcctgtggcagatcctgtagcagggagggccggcccaggctgtctgtcggcctctcctgtctgaaagccacagagttgcgggggcagggaccaggaagtgggggcaggggtgggctgtctaggaaggttctctgtgcctgcccaggaggcaggcagtgttgaggactgagcctcagggtggctgtgtggctggagatacagcagggctgctttccagggagggtgccctgaaccgagtccaattctggaatcttcaggtgtgtggggtcagtgggtcggggccatcagactggagttcagagctcccgtgtggctttgagcctcaaggacgtggcggtagaggggcccctcacaggcgcccgagggcagagactgctgttctcagtagaaattgacacagaggaggcctgaggccctgtccctgggctgacggcagatgcattggtttgttggaggtggctggtttggtggtttggtggttcggtttcctggcctgcacacgtcactaaaggtgtctcaggaacattctacagcagcctgtggggcccttgtgtgagcaggactggcactgtgggatgacagggcatcctaggtcctggtttatcttctctgctcccagtggctgctgtctgtgcccctcagcttccccagcgtgatgtttttgcctcagtttccccagcgtgactccccacttcagcttcctcagcatgatgtccttgtctcagtttccacagcatgacatccccacctcagcttccccagtgtgatgtccccgcctgccatcctgtcctgcagccaagagctcctctgggctcagccaggactgctgatttgcagtcacgtcctgtctcgggtgcagcctggagcttcaggggtgtgacgctttgggggtcatggccaccagcctcttggaaacaccctctggagccccgccttgggcagcactgcatggccttgctgtgtttcctgcccggggccatttcattaatactgtgtttgcgggagttctgtctctcgtctttggagcgccccctccctctatttctgtacaggggagctgcttctttctttcttcccccatctttcctgcctattaaattcctgctccttaaaactaaaagaaaaaaaaaagaccgttgtgatctggaagcggggtcaccccaggacccctatggtgtggggggggtgttgatccctggggctgggagggtcccctcggggctgggtgtgtcgcctgggcctgatctgagccctccttctgccgcagctttccgggccctcctgcagatccgggcggtgcggaagaagccaggagccctgtcccccgtgtccttcagccccgtcctggcccagagcctggagcatgatgagcactctgtaagtgccgcctcctgcctgcgggatgggcgggagaggggcatgagtgcctgggccaggcgcaaggcccagacggtccagccagcagccccgtgttctcttctgtccagtgggcaggcatggcccccatggatggctgtgaggcatgaagggggtggccaggctgggccctggggtgccgctgctgggaacagcgctgctgccatcagtaccagagcctgcgacaaggctgagcgcggtcgaggtctcggtggagccaggtgcttttttttttttttttttctttttgaggcagggtctcggtctgtcaccgaggctggtgtgcacccaaagtggtgcaatgtcagctcactgcagcctcgacctcccgcctcaagcaattcccccatttcagcctcccaagacgctgtgaccacgggcgtgtaccaccacgccgagctaatgttttgtatttttagtaaggtggggtttcccatgttgcccaggctggtctcgaactcttgggctcaagtgctagtcctgcctcagcctcccacagtgctgggattacaggcctgagccaccgcctccaccccgtggttcttagtgaatgagccatgctgtttcccccatgcgctgctgtgcaaggggcactggtgaccctcctcccacgctccaggcccaccaggcgccctcagtggggaccttaagggcaggccctgcttcagcaacacaagggaggtggaaccctggcttcaaggacccaaagacagacagagacatggagagagatgcacagagaaacacagagacagggcgagagagaggtggagagacacagggagaggcagagacaaatgtggagagacacagagacaggatgagagagatgtggagagacaaagggagagacagagaaagatgtggagagacatagggagagactgatggagagataggaagagacagacagatgtggagagacggagagacagatgtggagagacagggtgagagagatgtggagagacacagggagagacagagatggggatgggtggcaggggctgtggtgggcagggagcagaatgggggagttggacagtgactggttgggcccgggtcttaggccccctgctccccactggccacgcgcattgtcagattgagtgcctttcttggctcttagctgtggctgttatgagccgttggttcttccaggctctgctgcctctctaaacagaaaagaggagcagagccctgaggactggcgttcacagacagcgcctttgctctagaaggctcctcccaagcccccttgatcagggccttgacctgggccctatgggcctccctggcagcaggtgcaatgtttctgaaatggggtcaatgtttaaaagtctggaatttcccttaaaacccagattttgggtttgtcttttaaaatctgacatggtcttgatgctagaggagaaacatggcttgggggtccctgtcaacccaggccctctaggcccctaccatcgtggggctcctggcaccacgctctccagcacttttgatgttggctttgattcggaaacgctgcgtgtgctcaggtttttggtggagagagaagcagcccctgagggatttgcctctgagagggtttcacctagggagtgatcgatgctcaggcgtggctaggtttattgtcccttgtttttgcccctccctgtttgtgttctggtggctgaggatccagtaggtccctccatgtttgtccctcttatgctgagtgagctgggcggccggggtccgaggtgtgaccaggcagctctgacctccacatgccccagaagggctggcacccagccagggagccgccgtcctctctgcatggagcaaaagcaaacgctcctcctcacctgccaggttcctgttggagccccttccacgtagtgacagaaagagccaccgtgggtgttctctccagcgagtgcctaaagatgatggtggggtgggtgggtctggggctgactcttctccccagccctcttgaggggttcatggttggtgataagtgagcggcggtgcctgggcaccggctggctgggggactttgaccagtgtggcttcaggatctccaccctgcacccagcctgcattaggcagcgttcagctgccctcacgtccaccttggccaaatctgttgccccaggtgacccagactgcggggggacaggcaatggggatgagattgggctccacagcctccccactgcagcagcacagctcccgggagctgccgagacgcacacatggcccacccagacccgagtcaaccctcacttaggacagtcccgagattcacgtcccccggaagcttgtgaagttctgcgccacggtgtggcaagaggacagccagtcagacctgtccagcccactccagggccgcgtgggggtggtagttgtaaaacatatgatttttatcttgacagtgtccctttaaaaaatcaaagccgcaccccgcctccctggccagcaagaaacctaaaagggaaacagtaagtgtctggtcctccggctacgtttttttgcccccgccctcatttttaaacccacgacaagtaggggagatcgtttccgccccaggctagtgtctgattcatataacccgtcagctccacttgcccagtcccggcctccctgcccagggagtttgtggaaccggaaaagctctcggtccgtgggcgaaacgccaggtgcgctggccccgccgccctcccctcagctttgcctccgccccgcgtggcccccgtgccgtttcccttttttttcttgctggcagtggaatggacgttgcaggcggaactaacgtcgctgctgcgttttgcaatcgcgccccgcgcatgcttcttggccccgtgtcccgctcctttaccctgcgggttcgagctccttgggctgagctttttggtttccttgggcttcccttgtgccccagggagcaggcagggggaccagcacacaaccacctggagcctccgtggcccaggcagacccagccgaaaccctgtgtgcgttggtgtagaaggtggaggccactccggagccacccggaccgtgttttcctttctagaggggtgaggggattctgtgtggttatttacccttaacttggaggcaggtatgggagcaaatgtggggtacacagaggtccagaaaagcatcccgggctcattgcccgggccgtgcccgctcccccatttctcccccacctccccgtggtctccaggcatcccgcacccatctcactttccccttccttccaggagctcggtcaggcaggccggggtctcccgaaaggagcactgacgagcgttgtgcccctcaacctggttttgtggggacagagcaggggcccccgcagtctgacttccgttccccagaacctgggcattttccttcttcctcagccttgttgattctgtctgctcccagtgagggaagaacagtggctcttagccagggtgcccgttagaaccacctggagcaggtcagcccccagaggcccgggcagggcacagctcccaacagctcagctctccctggtccaggacgcccctgaccgtgtctctcgcctctggcatggctttgctctgcccccgctcccagctcctgtctgtcactaacccttcactctccacctggggccaggcgggactgaaagccagggaggggctggttgaggccagggctggggcggttcttggcagatgccctcgtgcccgtcatcccaggcaccagcgtgggcatttgggcatccagccccgtgctggagctgatggctgaggcagggagggcatcggtgctgccagggagctcttggccaccctctgagggtgggggagtctcaatcccccaaagaacagagtggacaggaggtcatcaggaggagcgtctggggagcaggtggtccctgggcatgagccccctcacgcaccctgtccctacagaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacaggtgagcagcagccaggccaggtgcatggcagggtgtgtggtggcgcgcgtgcggagcgggtgtctttgtggtttcaaatcagtttgtgatgtgttctgtgtggcgattccccagaaggactcggagaccccgtatcaggttagactcatgggtaaagtttattacggcaaagaacgcagcagacgaggcaggaagagcgtccgggcagctggaggctttgatcccccgaccagggccacaccggcgtgcaggcgcatacgtgctctcgagcaggaaactgcaggggtcggtgctgtgtctctgctgaggggagcccctttgagcctctgggttcccagacttcattggggggctggccacgtaggcccactctgccggtgaccagccagggcagccgaaactcaggacctgacagtgacccaggcacactcactgctcttgccgttcgcccgtgacgagccacggggcacggtccctctccaggcgatgagtgcatcatccatcactcatacgacagccttcggagggcctggctcctggggttggccacgggtcattcgtggttcccctggagccttgcggtgtatagagcggcggctgccagggggactctgtgcctcaggcctgtcggttctcgtagaagagtgtcaggaaggcgcgggttctgcaggcccgccctgggcaccctccatgcccacgaggaggcagcgccaaagctcagagaaacgggggcctctgtctcctgctgcttctcctccccaggaaccaccagcggtttctcttctccttctagaaagaaaaggaaggctaggcccgtgccagtgtgtcgggagcccctctgtcgggcgggtctgtggtggccgctgttgcctgttggccgtttgggttggtcccggtggctggtgatgcccttctccagggagtgtccttgcgtgggtcctggcaggcgtgtgcaggggcccccaggtgccctgcatggctttggcagggttagccttccttgtcgttatcctctcacccctgcccaccctctcctctgtccccagcaccctacggtccccgtcttcccccatccacgaagaggatgaggagaagctctccgaggacgtggacgcccctcccccactgggtggcgcagagctggccctgcgggaaagcagctcccctgaggtgaggcccccccggggaagctttgcgcacccgcccgggccagccctcctccagcttctgtcgctggaatcagaccccatcccactgcccgcctgggcgcccccgtgcttgttggctcttgctgagctgcgcggctccttagcctcggtctgtggaggcagcaccccctggtggagcggctgtgcggtcccgggagggccgtgcctgatggcggcttgtcctggagcggtggccgcggctctctgagctctaggctactttcccctttgtttcctagagtttcataacagaagaggttgatgagtcgtcgtcaccacagcaaggtgagcgcctccttccatgggcacaaaccgcatgcagggaccaggcagccctggcttactggggccttagggctccaggtggtgttgggccagcacctcttctgccccaggaaccctcggccaagaggcccccctcggcggcactgggatcccggctgggagggactgaacgggtgactgggtcaggctgcgctgttgaccctgcagggctgtctgcctgggatggggaacacctgccagcattcagtcctggttttgaaacatgagcgtgtaatgtttctatgaccaaaaaaaaaaaagccctatgctctgaacatccaggacacagtgtaaaaaaggggaaaaaaaagccccatgctgggggatgggaaggagggaaatagaagggaaacacccagctttggggtccctggagagcaggtggggtcacggtggagtcctgctggagcacaagcctggggtccccacagtggctacagagcccttgggtaagagagacggcctcctgcccagagggacctgccgggacctggcccctgcctgtaggtccctaacctcaccctctgcctgcagggacccgagcagcttccattgagaatgtcctgcaggacagcagccccgagcactgtggccgaggcccacctgctgacatctacctgccaggtaaggggctgggggtctgggggtgaggggctgggtgcctgtcttagtccccagggagggggccctgctctgatggtcggtgcatagcagcagaggctgtccattggagcctggttctctccctggctctcagccatgcccctgctattgaccgtgaagcaggatgcgggccagggccatggccacaaagcagcctcaggcagggcctggctcttgggagcggaacctgcaccaaagccccttccctccctggggccacattggccacaggaggtgagagacgcgagagaggctgcctgtgagaggatggggtccttttccctctgcctgctgctcacgccaggagggcagatccggccccactgggatcaccacatgttcccccactcctggtcctatcgtgggcccacaggccccatgctgggtgccacgtgcgctcctggcagtgcctgagagctgcagacagagcaggagcaggtaccacacgctgtgctgggtagcgggggccctgggccacagagcgcaggggcagtgtcttctgggtcaccctgccccgggcctgacagaggccacctgatgcagcagcacatcccaggccaggcacagaggacggcgggggcgccaggcgccagcggggaacagcaaggcagcaaggctgggacagagggttgctcttctcacctttcccggaggctcgggccccagaccccatcagccaagcaccttcgtgctctgctctgctgggataagatcctcagtttcgaatcctaagctctaaagaccgggagggaatgggggctctcagactagtgtctcagcacctgccacgaggctgtctgcggctctggaactgcgataaacagccacggtgctttcagacatgaccccagagccactgcttagggagtgtggctcttccctcgcggctgccaggcttcacccgcttcctggccccagggcccaccattgctcaatcctcctgagtcacctggtgacctgggcctgacattgggtggttgtgacgtgctttagttggaaaggggctcttgtgcccccggactctggctgagcagtggcctgtgctcatgggctgggcgtgacaggtcgcaggtgcaggagcaggcactgcctctggtgccctgatgaccacagcggcctgccccgaacaactcacagcagaaggtgtgtttaggaccagcttaccttaaagtgacacagaattcgagtaaggtctttcagaggatctcaaatatttcattctgattaaaaacttggggggtgatcggggaagaggccagaaggacctcagcttctgggagccacgaacatgatatctgatcctgcagggtggccctgtgggggagcatctcagaggctgcgcctcccctctgtggccaggcctgggaaggattgggacagctacagaggaggcccacacagaggaggccaggactccgagtctcatgccccacccacaggggagggtctcgggccttcttcaggcccacagacgggggcaggcagtcgtcatctgtggaggcggtagaggagaggccgagtctacatcggggcagcctgaggtgaactcctgggccctgggccccgctcttggagttggctgctgctgaatgccagcaggtcagcctgcacggcctcagttctgagccacggagagcacatgtgcctttgggggctgtttggcgccatctccgtggctgtcagccttgtcagcacaggtttctgtgtgtttttaaatccatgtggtggcccctctgttccactgactttttcacatcacagagcccttgactgtctatccgtgtctgtgcgtaaggcatgaacacacgccagagcctttggtttctcataggggtgcagccgctgcctggcggggtgggcggcatcactgaaccctgctgtccctgtagatgggagggcccatgagatggtgaacactgggggccctggtgtcttggacttggccctgagctcggtcctgtctagcctcagccccccacccagggccttcactcctgaaaccagaggtggactgcgcccgttaggtccttcatgcgcccttccctaggctgcggcagcgggaggtatgggagggaggggcagggccagtgcgctcctccgcgttgaattctggctgcgctctgcctcccagctgtggttctccttgtggttctctgtggttgcagcagagtgtttgtttctagacggcctcgaccgtgtccccaagctggtgcccttgctgtggctgtgctggctgctgcgcgcttgctaaccgagcttccgtctgtctctccccctctccgcgcagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 313 - DNA, 66150 bp, Homo sapiens; identical to SEQ ID NO: 312

SEQ ID NO: 314 - DNA, 66150 bp, Homo sapiens; identical to SEQ ID NO: 312

SEQ ID NO: 315 - DNA, 66150 bp, Homo sapiens; identical to SEQ ID NO: 312

SEQ ID NO: 316 - DNA, 214025 bp, Homo sapiens
ttagattagtacaggtttacttttaaatatttaataatataaaagacttgcatagcttcaattcatttaagcttcccaataatgggtaaattttaagtttcctgaaaagtgagatcatccatgtagacaatcctgtttttgacataattgtccaacgtggaggaggaaacttgttaaggccttccatttatcttaccatcagtgacagctgagtcgattttctcttctggtgggtatgctttgttccttttggaaaatgcctggctgatttctgcataggttctgtttttggtctcaggcagcacaaaatacaggtagatagcacctgtgatacaaattgtagcaaagactaggaaacagtaggtgtccagacttttctgtggaaaggcagagacaaaaaccctcaaatagataatcagtaaacttgctgttaaaccatctctacacagatttttaagatagctccacattcatataccaatactcctagacaaaacaccatgtgtgatgctggctcaataaggcaagtgtaccctacatgaagtgttatcacataaggcttgaataaatcagcttcaaactctgggaaagatgagaaaatggcacttttttgttgttgttgttgcaaatttggcatttaaaaattaatcatcacgaaagcaaaatggaatgcttgctgaatattagcttaagcttatatttacaattaaccacattgtcttcttgcttctactatacacatgagacaagaatgacatcaaaagggaagagaaatgccttagttcataggaagaatgtggagcacagaataggccaaggtaatgccagttttttctaatatgcaaatgatctaactcactaattgatactctgaggcggccttgcacaaataagagagatcagaaaaaatagaaatgctcaatgcaatcactccgttttatgtatcctgattagtgtttggactagaataaccctgccaactgcactagaccttgagcttctcagtgactcagtcacctctgtagctcctgtgccttataggaggtactcaggacatatttgtggaataaaagacttgaaatcctagcctcaatcaatctgcttgctttggtctcccaggtactgggattataggcatgagccaccattccagaaataaaagactttctgggtcccagctgtcaggattgtgactattatatgcaacaaacatctactgatccaaagataaggtgacactgtctttgaataatatttcccaagaagcaatatccagattttagtcaattccattctattctttgatttgacaaacatttatttttggagaatggcaaagtgcttaagcttgatccctggatcacatcctagatctaccatttactaaatctgagactctttgtccctcagtttccatgattgaaaaagaggataatcatggtacatgtagggttgttgtatgaattaaatgagacattccctttaaagtgccacatgcagtaaatgttccacacctgggggtgcttagctcttgagactgtgccttctgctcgtacaaagacttcaagagtagtgtggagaagggggagagtatgggctctgaagccagtcgagtgggattcaaatcctgatcccattactcacatgttgttctaacacttatgatgtgccatttaagatagaatttcaatccactgagcatctgtttcctcatttgcaacatggtgatatatacccacacattgttttgaagatgaaatgagatatatcaattttgcattcaacatcctccacacccccatctgcaggcggaatggacatctgacttatcaagtccaaagtggagcctctaaaactgcctgctctagccttcctcatctctgctgatggcacctccatccttctgattgattatgccaacaaaaacacttggaggcaggctgagcttctctctctctctcccacccacatctgctccatcaggaaatcatgttgctccaccttgaaatgtattccaaatctgagggtttgtcatcacttctattgtaacctaattttggtgcaagccaccatcatgttttgcttggatttttgcaatagcttgtcaactgatttccctgcttttcactttaagcataatcttaagattattcttaacagacaagccagagtgatcctgttaaacaaaggacaaaacttgtcactcctctgctcaaaacccaccatgacttcctaagtcacctgcaggaaagccaaagtcctcaccatggcctccaaggccaccgaccatgtgtccctcttatttctctgatcttactctcctcactttctttgccccaactccactgcctttatgatttccctccagtattaggcctcagaatctttgcacatgctgttctctcttgctggaataatcttcgtttaggcctctgtatatcctgctttcttactcctcttcatccgacttaaaggtcattttctcagagaggttctcgttgactctcattttgaaatagcccctcccagccctgcttcattgccttcaaaaacactcatcactatgcagcattatagtgtgcaactgcctgtttattaaccttctccctaccaagaggtaactatctgaaggcaggagtcatcatttttcttgtattcccagagcccggagagtctctgatatacagtagatgctctgagtatcttagtgagtggatggatggactgaggctcagagaggcttcctgccgtatcccaggccacaaacagggcttcctaggacctctctgacacccacacagctgcctcttgcttggctttcttttcccaagggacctgatgggtgtcgtgaggattattctcacagtttcacaaaattcagtcaagaacatgtggctcagccgagcacagtagctcacacctgtaatcccagcactttgggaggctgaggtgggtggatcacttgaggtcagaagttcaggaccagcccggccaacattgtgaaaccccatctctactaaaattacaaaaattagctaggcgtggtggcagtcgcctgttatcccagctacttgagagactgaggtaaagattaaaactggaccccctccttacaccttatacaaaaattaactcaagatgcttaaagacttaaatgtaaaacccaaaactataaaaaccctagaagaaaatctaggcaataccattcgggacatagtcacgggcaaagatttcatgacaaaaatgtcaaaaaaaaaaaaaaagaagagcaacaaaagcaaaaattgacgaatgggatctaattaaactaaagagcttctccactgcaaaagaaactatcatcatagtgaacatacaacctacacaatgagagaaagtttttgcaatctatccatctgacagaggtctaatatccagagttcataaggaacttaaacaaatttacaagaaaaaacaacctcattaaaaagtgggcaaaggacacacacagatgcttctcaaaagaagacattcatatggccaaaaaacatatgaaaaaaagctcaacatcactgatcattagagaaaggcaaatcaaaaccacaatgagataccatctcataccagtcaaaatggcgattattaaaaagtcaagaaacaacagatgctggcgagcttgcggagaaaaaggaatgcttctacattgttggtgggagtttaaattagttcaatcattgtgaaaaacagcatggtgattcctcaaagacctagagacagaaatgccatttgtctcagcaatcccattactgggtatctacccaaaggaatgtaaatcattgtattataaagatacatgcatgtgtatatttattgcagcactattcacaacagcaaagatatggaatcaacccaaatgtgcatcaacgatagactggataaagaaaatgtggcacatatacaccatggaatactatgtagccataaaaaggaatgagatcaagtcctttgcagtgacatggatggagctggaagctgttaccctcagaaaactaacacaggaacagaaaaccaaacactgcatgttctcacttataagtgggagctgaacaacgagaacacatggacacattgaggggaacaatactggggcctatcagggggttgtggtggagggagagtgttaggaagaatagctaatggactctgggtttaatattaatacctaggtgattggttgatctgtgtagcaaaccaccacggcatgtgtttacttgtgtaacaaacctgcacatcctgcacatgtaccccaaacttagaataaaagttgaagaaaaacaaaaagctcagaaaaagtttgactagtcctgcccgtctcactctgcttaggcactcaggatatgacccaatattcttcaggttgaaaagaataatttgctcttttccagaatttattgagctcaaactgcattttataacttgagtagaatcaaagaggcatacatttgcatgcaattttctctgaatcggaaaatattggcactccacactggagagtgtttttcgcaggctttataacaaatggcccaagcaacactgatgctgaccacagcaaatgctgccaacaggatcccagagccagagtgtggaggtgagcatgaagggatgtgggctcctccccacaaccacagttgcctcccttctctgttggtgatgagaaggctaaggattttccctgttttacaggtgaggaaacccaggcttggagaggaaacccatgcttgaggagcatgctcagggccctccgctaatacatgggcttcaatacaggcgtgattcgtgccgttgtctgtggctctactggctcagacattttattctgaggaagaagcccaggcttcttaggggtctgtttgggggctggaatacatttgccactgatacttattggaataagtgaaacaatcaagttgtgtgagtagtttctcttggtggctgctgtgggctgaactgcgtccctcctgaaattcatacgttgagtcctaagccctagcacctcaggatgtgattaagttgaaatgaggtcattagggtggggccctaatccaatatcctgctattctcataagagaggagaagaggacacagatcaacacagaagggagaccatgcgaggacacagggagaagacagctgcaaggaacatggttgtgctttggtcaagggtaggctgaggtaaacatccagagtgactcagtgagtttagagggcaggtgtataactctacttgttatcacagccatgtagccataacatgggaagggcatcccttggccctacaccactgttgtctgtaaaaggtataactgccctgctgacactgtacatgcactcttgcgctgccgcccagagaaagagagagaaaaccagagctgtccatctgcaaaatggaaagaggggagccaggacatagcttgagttctggtgcccagagaaagagttaagctgctgaccttgaagggcaagctggcagtgcagccatgtgtgggagctgctggactaagcagccaagacagggtggacagtgtgagagaactagtgtgagtgagcttctcatgagagactacattgcacctgcctacggccccctgagtgttcttccagctgtctgctcatccacccactcccttcggacctcagcatgagctggaacctgaccctggggataacaattggtgtagttgtgaacttgacaacagccattaacaagccaaggagaggggcctcagaagaaatcaaccgtgctaagcccttgagctcagacttctaccttctagaattgtgagacaataaatttctgttgttgaagctccctagtctgtgctatttggtcatggcggcccgaggcccgagtagatgaacacagtagctcttgattgtggctgagctggttttcagaagggaggtaggtcagaaatggttcacgtatggcatctagaacacatacacgttgctcccatgggcgggcgtgagtggggctgtggtgggctggggttgggggatgtgactcagaacttgttagccctgtatttctctaatgcattgatcattgctcacagcagccccctgagcccagctctctaacttgctaagctcctctccggaaaggaaattaaccgtgggtgccttcccaggcttgggtcaggaggctgacatttcacaaaatactaaacgtatctacctgcccagtgtctccatctgtatgtccagcctggctgttcctgctccgatgaaggttcatcaatagtcacacctgcaatgtttcccgaatgacccctgaaaacccagacaccctggacatacccagcttctcaggaactgtttccagaggggatttgtttcgaaaatgcccacaggcataagaaaaggctcataaatgacaggcaagagaagcaagaacaaaacaaagaattgattccagtttttagaaatacaaaaaattatctaggtttggaagtgcagtgaccttggaagttactacatctctctgagctcatccccttgcctgtcaaagggagtgatacaggcactacctcctagcacaggcagcggtggagcactctgggcacacagcaagcattcagtgaacactatactaaagtggcatgttggtgctgttaatgctcaaactgtggcaggcaagcaaggtctttcacaccccacacccctgagtggctcagaagatagtggcctgcttctcggacatacaaatctcagtactgggccatgtgaaggtgctggaacttctctacttaatttataaatgtgatgggggaaccatgttgacagaagcagcttgaagttaacttttgccacaataatgaggattttactgacacctggctctgctggctttgagccaaactgtaaaaagccacttaaggtttaaagtcaattgaaaagatacttgttatgttctgactgcagccacgtgaaggtgtcccaggatgggaataaatgagtgtgggatcttgactaactccatggctcatggagcccccagcagcccttacgtttcagaaatagagtgtttgttgctaaaacacaaagatgtcttgaaagttacagggtgtggcagccttctaactctgagacgaggaggctgtagcaagtgatggatggagagggaagttgagcacaaggtggtgaagtggagaaactgggtttgatgctgactgtgggacctgggctgaccatgtctgcttcctggacctccttgcctgtacagtggcaaggatcagaaactccagctcaggactgtgtgagggtgatgtgggcacagaaagccatgcatgggggagggtgcggcacagagcaactgctccgtaactgtgaatgcaggaacagccaccatgctggggtggctggggcttggagtgccgcaaatactgacctttggctcacccaagctggcagcagaatctctgggatgtgttgggcttggcactagtaaattagcaggcggacttagaactgagtgtccagaatagttggtgaggggaggaagacaggaagacaggattgaaatagctcctgagaatgggtggtgatgtatatgacggattctcacctcctccaggtggtaccacccagcactgagggcagcagggagccctggtgggcatttgagcagggaagcttcatcctccttctgcaaatgcttctgggccccttgctctgtgcagaaggcttgcaaagccttttgtgttcctgctcccagataaccctcttatctgatcctctctctcacccatctttcttgctcactctgtttcagtcatataggcctctgggtggtttcttacacaggccaaatattagccctgcctaagggcccttgcacttgctgtttttctagccaggacttcaccattcccagacagctctgctccctcacttcactcaggcctctgcgcaacggtcacctccttccagagcccttcacgattgccccatttaaaatagcacttatgcctcttttgtttccccgttcagctccagaaccaggaaacacaggctttgttaccactgtatcctcattgcctagaaaagtgcctggcacacagctgggactcaacatatatatgtgttgaattaatgaattcggtttccaatgaacagatcctttccctacccaaaaagacttgtatctgattcttgagtatgtgggcattttcctactgatcactgtcacccttgggacaatgatcccattagctgtggttatgatgatgacaatgaggatgttaaatgggtggtggtttgcagtgtgcactggaactattagatggaatttgtcttacacagtgatgagcacattgtaaaaatgataagtaggttgtaggtttgagttgctaacctaggagtccttgcataccgtcagcaatgggtagcccacaccctctgaaagagcccacagcatttagggaagctctaggaaggcacaggaaagagaaagggatgaaaggttttgcccaaagcatagtttcttccttccttaggaaaatagcatgagtttccagttgagaggagagagatcaacttctgctctatgaatcacccctcaagtgctgcagaatcaaagggaaccccatgggcaaaagactccttgtcagtcatacctgaatgaatgggaagaggagcccaacagcaaagttggagagccagttgacggtgcctgcaatgatgaaggcagccggccgctgagattgctggaagaactcaccagtcaagatgaacgggatgccacctgcagtgtgtgagccaggacatggaattaatcactctgagaaggtcatgcctccagcatccatctccatctgccacactttagaacccccccacccctgccccttgactggatgtgtagtgggccccagttcctgagtcgccctggtggcattgcagtgggacaagtctttattttgagagactgtcctgtgcaattgcagggcatttattaccctttactttctgatgccaggagagcctccagtcaccaccacaacccaagccaaccctacacatttccaaactcacatgtggtctcaggtctatacccttcctttcctccatatcctgtacagtgagaccagtgatcacgccctgtgcccagaccaggacctagggctcagcatgactgctgggatcccacttgaacctccccatctccagctggagtcaccactctgccaatgagatctacacctgggtgtttctcagacaagacagagtgggtaatggatgggaaatccctcagggacttttactaaactctagagagacagtgaacacaatttggaaattactaggctggaggcattcattgtgtcaacatccaacaattatttatgtgctggggctgttccaacagtgaggtcaaaagcaacatgtccttgctttcatgcggaacccttgtctgctgggatgacttgttcattaaaatgggagtgagtccaggaatggaaaaccaaacatcgtatgttgtcactcaaaagtgagagctaagctacgaggatgcaaaggcataagaatgatacaactggggccaggcgcggtggctcacacctgtaatcccagcactttgggaggcagaggccagtggattacatgaggtcaggagtttgagaccagcctgactaacatggtgaaaccccatctctactaaaaatacaaaaattagctgggcgtggtggtgcatgcttgttatcccggctactcgagaggctgaggcaggagaatcatttgaacctggaaggtggaggttgcagtgagccgagatcaagcatattgcacaccagcctgggcaacaagagtgaaactccctctcaaaaaaaaaaaaaaaaaaaaaaagataaaagaatgatacaacagactttgggaactcgggggaaagggtgggaggggggtgagttataaaacactacaaattgggtgaatgtatactgcttgggtgatgggtgcatcaaaatctcggaaatcaccaccaaaaaacttattcatgtaaccaaacaccacctgttccccaaaaaacctatggaaataaaaaaataaaaataaaaaaggggagtgagcaaatgaataaatacatataaatacaaaatgtgataagcattctggaggagatgcactgtctattttggcagtgggtggagaaggatgctctggggaggagatggtggagatgtggattgaagacgggaaggtggctcctgaagatctggggaagatcatgccgagtggagggaggggccagcagaggtcctacaggtgaaaggattgggccaaagtctacaacaggggccaatctgtccagacacctgaaggaggcagagaggaatggggtgaggtagcaaatgtgagcagggccaatgaagcagcctcttgtagatcatggagaggggtttgcagttgaagaaaaccactttgggctgctatgcagcagttgaggtgatcaatttgcatttcacagaggtcactgctctttggagaaaagcctggagggtgtaggagaggatgcagcaggctgttggggcagtccagggaggaggcaatggttgtttaggggggctcagatcacggcaggtgagatgaaaggaagggtctgaatttggagacaattgctccattgaggtaaagctttcaaggtaagcattgcacatacacaatcacttagcaagccgacccaaccaagcagcccagggtgacaaagccacaaagccaaggccaactcaagtctgaatctctccagacctttcaccgttatcaccccactatgatgccagcaaggcttgcactccaacaaatcaaaaacaactcggaatggagcgtcccctcacctcccactacactgtgagcccctctgatcaggcactatctccatttgtctggcatttcccacagagtagatactccatcaatatttacttacataagttaaatgctcaaaagttgattttgacaagatttgatatgctgttcactacaaaaatattagactctatatcttaaaggtatctattgaactgtgtgagaataatggttacacactgaaatgtaatgaaaccagcctttggttctgcaaaatatttcattgtcagaaagtgtttgtgtcacacactcagttggtcctgcagctaacaccactgggaatcagttcacagcaattctgaagcctgaacagggttaggtgatgatgtttcactttctgtgtctttcctaggtgtgtttttggaagcacctgtggataactcagtacttctgaggctggtacaatggaatgcggtacatcaatgtacaatgcagtagaacactgacaaattgcctcctggtacatctctttgtttcttcagggcttgaggccatgacttgtttattggttaagactcctgatcctagcacagtgctgaacacataccaggtgctctgtaagtgtttgcaggattgatgaaagaacaaataattaggatgccagggaattcatggtacattgatatcagatcctctctttcactaggccttcagaccaagccctaagcaaccatgaggagcctgcacagctccactgtacacaggtgtgttcactcccattatctcccttgatcttcccaaccagagaaggtggtaaagcatagtggactggagcttgggctttggtgttagtaagatcaggtttaagtcctatctcagctaaatctttctagaacggaattctctcacctgtaaagtgagtaggagcttgctactggggatatttgtgagcatgaaatgaactactaaatgcaaacacttaatataagtcttgtacatgaagggcactcaataggtgttagatactataataataataatcaagactcctctccattatatcccccattttatgatgagttagctgaagctaagagaaggggagtaatatatgcaaggtttcttagcaagaagtgatggtgatgaagaagatgatgatggtaatgatgatgacgatggtgcttctgtagctgctggtgaagatgatgatggtaactgtggcaggcattatgaaaagcattttacaaggtctctacaaggagaactacaaaccactgcttaaagaaatcatagatggcacaaacaaatggaaaaacattccatgctcattgataaaaagaactaatattgttaaaattgcccacagcaatttatgaattcaatgttattcccattaaactaccattgacattcttcacagagccataaaaaaccgttttaaaattcatgtggaaccaaaaaagagactgaatagccaaggcaatgctaagcaaaaagaacaaagctgggggcatcatactacctgacttaaaacaatactacagaattatagtaaccaaaacagcatggtactggtacaagaacacatatatagaccaatggaacaaaatagagaacccagaaataagactgtgcacctacaactatctgatctttgacacacctgacaaaaacaagcaatggggaaaggactgtattcaataaatgttgttgggataaatggctagccatttgcagaagattgaaactggactcctcccttacaccatatacaaaaatacactcaagatggattaaatacttaaatgtaaaacccaaaactatagaaaccctggaagacaacctaggcaataccattcggcaaataggcacaggcaaagatttcatgacgagaacaccaaaagcaattgcaacaaaagcaaaaattgacaaatgggatccaattaaactaaagagcttttgcacaacaaaagaaactatcaacagagtaaacagacaacctatagaatgggagaaatttttgcaaactatgcatctgacaaagatccagcatctatatgaaacttaaacaaatttacaagaataaaacccattaaaaagcaggcaaaggacatgaacacttttcaaaagaagacatacatgtggttaaaaatcatatgaagaaaagctcaatatcactgatcattagagaaatgtaaatcaaaaccacaatgagataccatctcacaacagtcataatgcctattactaaaaactaaaaaaataacagatactggctgggttgtggagaaaaaggaacatttatacactgttcgtgggagtgtaaattagttcaaccattatggaagacagtgtggccgttcctcaaagacctaaagacagaactactattcgacccagcaatctcattaccaggtatatacccaaaggaatacaaatacaaagatacatgcatgtgtatgttcattgcagcattattcacaataggaaagacatggaatcatcctagatgcccatcaatgatagactggataaagaaaatgtggtatatatacactatggaatactatgcagccataaaaaaagaatgagatcatgtcctttgcagggacatggatggaactggaggccattatcctagcaaactaaatgcaggaacagaaaaccaaatattacattttctcacttataaatgggagctaaatgatgagaacaaatggacacatagagcggaacaacacacactggggcttactggagggtgggaaaacagagaggatcaggaaaaatattaataacaaataggtactaggcttggtacctgggtgatgaaataatctgcataacaaacccttatgaaacacatttacctatgtaacaaacctgcacatgtaccccgaacttaaaaataaaagtttaaaaaagcactttacatatattatcttatttaattatcactatgatatgatagttactgctattatttttccatttactatacaaagaaacttaggcttgtggaaggtaagtaattttttcaagagcacatcaccagtaagctgcaaactcagtgactctgggtaactccacagcatgagttttaactactcccttgggccccaagcaagtctaagatactaacaaaacttaaaatacttgaaaagaacttagctatcttcatagttttatctgaatgctctcccaaaccctgcaattcatttatctctcttactgaaggccttggtggcctgatttcctaagagtcttttaaggtctctttcttccaatccaaggtaaaatgagaaagaatggggtttgataaagaaacagaatgcatttcaggcaggccttcttttatttttattttgtttttaagaatgaaaatagttttattgtttttttctgactttcatgaataatatttgctcatgtaaaataattttttaaagcatgcaacatgacaaagtataaaaaggaaacaaaaattacctctaagccttccacctagagatgatctccatttgtattttggtatttagctttgatgttaaatgttctgtgaagaagattggggctacttgggatatttgtcttttaggtgtttgcctttttctacctagaaccctgaggaaattgttctttatctttgaaattcattaactatgatgtttttggttgtattagtccatttttgcactgctataaagatatacctgacactgagtaatttataaagaataaagatttaattgactcagagttccaaatggctgcggaggcctcaggaaacttacaatcgtggaggaaggcaaaggggaagcaagacacgtcttaccatatcaaaagaggacaaagagagaaagcaggggaaacttccactttgaaaccattagatcttgtgagaactccctctctatcacaagaacagcatgggggaactactcccatgattcaatcacctcctacaagtccctcccctgacatgtggggattacaattcgagatgagatttgggtagggacacagaaccaaatcatattctggtgttgattttcctatagcaactttttgtagaacatagcatatccctttgagctgcagatccactcttcatttacttcttatgttatacctttgaaaatgtcttattttctacatgttggattctttgctttagagacacccattatccttgtgttggatcagctttgtttccctttcctattggccatctcgtgagcgactttgttctcttgttttctgcatagatattgtatgctctgggaaatctctctcttccttcttctctccctttctttcctttcttctttgttctagtttcccaggttggctctttccctgtgcattgtcctccatttctcttatccttattgcagtgagctactttgtccagattgccacctgctgtgatatgatggaagaccgatctttgacaccttttctttttatcttctagtttatcttggctttcacatcacagtttgagatctgagtactaactttcagtaagttttcaataaattatgggaaaatgtggcaggggtggggtgggtagaaaaattggttaggggtgtcagcagccctttatggaggatctgggttcttctctctctcttcttagattttgtaaagtgacatgcaccggaacccattccatgttgtcaggggcatattctactccagtggcctttaactggtttcctcaaattaggacatagtcttaggaagtggcaatccccaggaccctttgagagggctgtttggggggaaggtatcttcttgatctttctctgcaattgctgactcacctgctcactctgtctcccccataaaatcaaggtggtagcaagagttcttagggttcataaaatctccttctctggtcagtgctgttttctaaagagtggagacagaatctcctatgctagaattatcctttattggctgctagttttctaggtatgtgatatatttccttgtttggttactgctggccattttttttcaatctgtgtaaaggtttgctttgttggtattgttattgattttaacgactcttttcctgctcattttcttaggtatttgcaggaggaaggttctgtaacaagtctatacatgaccatatttacctaaaatcccttgattattagcttttcaaaggtaagttattggtatttcttgtggtaggtgtgtaggtgctgctcatctgaaaatcatatgcttcaaaattaaagagcaggtgaaaacaatcccttcttacaaaggattttgccaagagagtgccttctttaaaattctgtggtttgcgacctttacttttgtggacttttttattcataaaaatacttggcacaccttatctcatcaaatctttcttcatgaccaaactatgaattatgaattgtaattacagattcggaaactgaaatttcagggaatagagggccttgcccagttactagtcctgcttgtgactggaagagataggacatgaagttgggtcttctgaccatgtccttttgatggcacctctcatttcaaaagaacagaaagatggggaaggtgtcatgtctgtatccaatgtgtcttgcacagggtactcttcatatcacagtactcaatatatgttgcccaacagtccaatatagcttaaactttgaaaattagccccaaataattatgtatgtgggtccactcatcttgttatcttattagagtcttctttgctatcttgtttgagtatcctattctggattgccccagaagcagaccctgagaagcagtttatgtgccagttgatcccaggaaatgcagggaagagtgcagggaggtgaaagaggtggataagggctatgttattagcaacaccaccatgggaagtcacatcttaatccaactgggaccctcgggaaactgtggaaaacacatctcagagttacccagtctgaggggtaggagggctggattatttatccaccatgtctcatcagtcactcattgagtgttatactttgagcagtgcttttggcctgccacaatgtgggctgagagagctggggaagtcctcaagcaaaaagccacatacgggagcagttgtaggtctgtctgagaatcacaaaggggtgtggacaaagggatttggggaagataacaagaatctttgctatgccatctattccttaagtgtttaacttctcattgactattgcaataatcaggtagccattactaataacaacagtgaagaaaatgtttatatcatatacacctaagtactagtttcaggagttggggtataacactagcattaagaacatggggtggaggtcccacactctaattaggagcatggagtgggggtcttatgctaaagttaggggcctggggtgagggtgtaacactatagttaggggcctgggtgggggtctgatactatagtttggagcatgctgcttgaatcagaccatctgggttagagtcttggctctgccacttgcaggctctatgtgaccttgggcacattagttcacctttctggctcgactttcctcctctgtaaagcaaggacaatggaattgattttatggggtcattgcaaagcttaaaggacctaatgcagagaatacacattgaattgtgtctgaggtgtgatgaacactcaatagcttttaatgatgattattattattcagaagaagcatgttccaggagaatattcatcctgtgatctgagtaagcttcctggctcctggatcccatggacactgagccacacttgttgactaactgtttttcctgagtgggtggtttgcccaccaatttgctttggcagaaaaggccttccccaataacatatagtggctcttgccttagtagcacatgcactgtggaaaaggaaaccagatttgaatccatgcatttgaggcatagaatcctatgatactgcctaggactctaggtaaaataaaaactcttattttacagattaggaaaatgaagctcagagagggaaatgtatttgctcaaggtaatgaaacttggtggaagagccagatttagtaaaaaaaaaataataataaaaaaaaaaaaaagtccttctgactcctttctttacagaataacaagaggtgatatggattgaggtatatgtccctcaccttgaatttattttattcccctctttctttctctccatctctccttcccccactcatttttctcccttcttgccaggaaaatagaaaatacgtgctgattaattgagtattctatgtaaagaattgccaagtaatttaaaaaattctgtagatatcctaaaaatattcctaataattttgagacattatctacttcattagtaatgccattatttttccttcagaaatgttcataagcaaagaaatattcttccccctcattggtaaattcctaatagttatacttagttatgttcaagtgaaaaggaattgaattatgcacgttcttcatatgagacttactttttgaaaactgacttttcctccagatctctgttctctgtgaatctgtgctacagctcagctggtctaacaaccaagctgtcttgtggcgacagcgccctggtgtctacagtgaggaacaatctgctacctttctttctccagagataaacctgatataaattcccatcactttacctactagctatgtgaccacatgtatctatggttctcagttttctcatctataaaatgaagataacaatagttcctacttagttttgttttatgcattaaatgagactgtgcttagcaatgcacacctgtggtatttctgtaaagccagctttgttatttctgcttccagcaatgtttcctacatattatctttaggccctttctccctcctctctattttctaactcttgcccacgtaccctagaaaaagttcaatttttttttttgagacagagtctcgctctgttgtccaggctggagtgcagtggcgcaatctcggctcactgcaagctccacctcctgggttcatgccattctcctgcctcagcctcctgagtagctgggactacaggtgcccgccaccacacatggataattttttgtatttttagtagagatggggtttcaccgtgttagccaggatggtcttgatctcctgacctcgtgatccgcctgcctcggccccccaaagtgctgagattacaggcgtgagccaccacgcccagccaaaagttcaattttaattttatttttgaataaaagaaataaaggacaactgcccaagcttttccttaattcatatttattaaaattattccaatggaaccacgatcatcaatttcttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgaccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccctgatcatcaatttctaaagcccttcaaaatgcctataaacccccttagaaatttccttaagtgtatccatatgtcacttaatcctttaaataaattttccgttaagcaccatgtttaaaaatagctcttttcttttattgaaatacagtcattttgaaaactcttcacgggcattctgttttgtttatgtaaatagacttaatcttgttcatccattcgttcatccatttccatccgacatttacatgtcaagtcctgtgctaggcaattgcagactctactagttgatgtaagaactatcttgggaggcagttattctaactccatttaacggtgaagaagttgcgacccagagtagagagtgacttgctcaaggtggcacgagcagtaaatgatagacttggctccgaatccaagagatccggacccaggtaagagactctctcctctgccctttctctaggagagacatttgagaatttgaaaatgcacaggctcccaaacagatgtgttccatgacaacagccaagatatatcagcaaatagaactcatgccctgcagcatgttggaaagggtgggactggagtgcacacaggaagctcctcccctcacaggatgtatgccaggtctgtcctctcatttctgagaggagcttagacacccacctgctcaggcatgtgcttcctaggtagggaggcaggggaggctgctgagcaactagggatgaggaggtatagcagatgcttcctggggtctccttgcagagccttgactcaccctgactctcagtgggctcctctggctctgctgaccaccaggtgagaggctttggtccttctctagacctcagtttccttgcctataatctcatttaatgagctatttaaaatctcagtaaagtcgaaaccttgatagtgcttacttggcacatggcaaattattaccatgtggaggtagccaggctagtagctaagaccattggcactaactcttgcccaagtaaccagagaaagctcaattgtaatttcatttttacataaaagaaataaagtgcacacccaaacttttccttaattcatatttattaaaattattccagtggaaccactatcatcaatttctaaagcccccccaaatgcctagaaatctccttaaaaatctccacaagtgtgtccatatgtcacttaatcctttagatatattttctcttagtcaccaggtttaacccagtttaaattcccacctctccacttccaagctgtgtaaccacaggtaagtcgtatctctggctctccattttcttgtacataaaatgaggacagaacaggagttcctgcctcttaggtctgtactggggattaaatgagataatgcttagcaacatgtttaatgtgtggctgtattagtccgttttcacactgctgtgaagaactacctgagactgggtaatttatgaagaaaagaggcttaattgacttacagttctgcacggctggagaagcctgaggaaacttatgatcatggtggaaagggaaggggaagcaagtatatcttactgtggtggagcaggggagagaaagtgaaggcggagatgtcatacacttttaaaccatcagatctcatgagaactcactcactatcatgagaacagcataaaagaaaccacctccgtgatccaatcacctccaaccaggtccctcccctgacacatgggaattacaatttgacatgagatttgggtgggcacacagagccaaaccatattggcaaaggcccaatcaatatcaatgattacggcgattcctcttctgcctgtcattaatcccctcagtgtttgctgggaacggactacgtgccaggaacccatgctggggcatcaatggtggcagaaagctgattcaacttctgccttcaaggagccgtcagcatctgaggtccactgagtcaagaaaaccagccctgagcacaagattaacgttctccttcattgggcagtaataataaaaatagttaaaatttattgagcactttctatgtgttcttgaaaggttttccctttgtagggtttctaattattttagaaaaggagtgataaaatgtcatcagatatggcatcagacattgttgatcttgggcaaggaagatcaaattatcaggagtcactggtctgaactgaaagagcaaaggaattttcctcctgttgtatccagagacactgcaaaagttagaggcagaaaatatcttagggaccccctaggccagccccaacccaatatttcaggtggggaaactgaggctagagaggtggagtgagactcccagtgtttcagaggagtaggatccaggacttccaaactagcctgattgactgctctactgtgtcctccctaggaattcctggtgcccacccatgcttagactgttcccactgctggaaatgcccccgagctttggaaagatttcaaggcacacaaggatatgggtaatttacttcacatgagcttggctcccagtataggataaagaagcaatggcgcctttttccccttctacacagcccaaccaggtagccagcataagtaactacacaagcctgtggtctcaccacatgggatgtgttttctaaaaaaaaaaaaaaaaaatggaaaggagacttctccaggaatgggcatgagacatgagcatgtattaattaggcaaaaggggcaggtccctccaccactaccttattctcgatcacagcctcatgtttatttatttccatggattgcatcatcatctttgcatttatcttttgcttgttcattgtgctcctcgagggcaggcatcttgtctctttttctccctgttgcttgccccatagccaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccggctaattttgtatttttagtaaagccggggtttctgcatgttggtcaggctggtctcaatctcctgaccttgtgatccgcctgcctcggcctcccgaagtgctgggattacaggcgtgagccaccgtgcctggccagaaattctttatgcagttgaggagatggagggctaaccagggtgcacgttcagtgagagcctgggctgcgatggggaggtgggacaggagaggcatcttgtgaggggccagcaggggtggattctagggtgtctaggaggccatgcttggggcaggagtttgcaggcagaagctgtaggcctgttggagggttttaggaggagaaagacaggatcagatttgtgatttgaaaagtgtccccgatgcagagtgggatatgggtcagcagaaggagggtgtggaggcagactgggacactggttaggaaacagtagttcagaactccagaaacaaaagggaagttgtttgtgaaaagaagttcgtgcctctcagcattgttaacaaccatacatggtgattctaacttgaatttgtgtaggatcagtcatgagacttagattgtttcctgaactctgctctagggaaatgtaaagtggttcttcctcttgactatcaattagcatgttttgacatagactttcttccagtgggatttaaaatctgtgttctttagttgaatcaataggcttgaacattaccatcctggactgtctgggggagaggatgtttttgaagagtctcaggagcaaatgggccatgaaaggccaaattgactgttaattctaattaaaaagaggaagctgctacagcataatgagtgtggacagttaattagcaggtaagaaaacacaattaaagtctctcagaacaaacctacagtgatgtgttctgtttggtggtgagttaagcacactcagatgacctgtttctaagcttggtgaggagtttctgtttcaatagagacggaggtcagcagtcttgctggtaggttctcatgggcgcattttaacattcttcctttttggatgagcatggtgctgggagggggtgttgaaatagaaaagcaagagtgactagataaaagatggtcgagctaggaggaacatctcccaccgagagaccgggacatcaggaagactggcacactcaagccacatcttcagagagaaggcattgagagtggatagagggaggatacagatgctgggctgaagcagggaagtctgggaaccctgcacggggctgctgagcaatgggacttgtttcctggcccccagcgactcctggggaagggatgagttgaacaggtgaggaatggcccgctctcaccatggacctccagaatcctagcagcaggataccccacaacccccacagacacttgagacgacagggagaactgcttagacaggtggcaggggcaggactccagcctgtgtgttgcccagagggtttggtgtgggaacatctgcagtgaagcatggccagtgatgcccattccccaaggcttgccatgctcctctaggagtgtgactgtcagacctggacagagcagggtggccttgcctgtgggatgaggccggtacattctgaatgccccccatctgctggactctcttggggccccagcctggttgtgcccagagggcagtatcagatgcccaaccagggtgcttccctgggaccctcttcatggcttctttgccagcagaccatgtcagaccatcgaagaactctagcagactggctcccactggtgtgcaccagctcacccacagcctcccctcaccgcagcctcccttcactggtgcacactcattcgtgccccactcccccaccatcccacatcgctttgctggtgcactgtgagtggaccttgcctccctctcttccagcacatgtgtgtgcattcatcacataatgccaccactgctggcatgtgcgtaccctgctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacttgagcgagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagtagcctcaaagattgtaggatcatcagtcaacacagatgagaaagaaccagtgcaagaactctggcaactcaaaaagccagagtatctttttatctccaaatgaccacactaattccccagcaatggttcttaaccatagtgaaatgactgaaatgacagacatagaattcagaatatggataggaatgaagatcactgagatttgggagagtcaaaacccccaaggaatctaaggaattcaataaaacaatacaggaggtgaaagacgaaatggccattttaagaaaaaaccaaacttatctgatagagctgaaaaactcacttcaagaatgcataatataatcacaagtactagcagcagaatagcctaggatgaagaaaaaatctcagagcttgaagactggttctcagaaataattcagtcaacaaaaataaagaaaaaagaataaaaagaatgaacaaaatctctgagcaatatgagattatgtaaagagagcaaatctatgactcactggtgtctctgaaagcaagggagagaaagcaagcaacttggaaaacatatttgaggatattgtccatgaaaatttccttcaggaaatgcagggaacccctgtgagatactatataagatgaacatccccaagatacatagtccgtcagattctccaaggtcaaaatgaaagaaaaaatgttaaaggcagctagagagaagaggcaggacaccaacaaagtgaaccccgtcaggctaacagtggatgtttcagcagaaaccctataagccagaagatactgggggcctatatccagtattcttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccaccgcgcccggcctccagtattcttaaagaaaagaaattccaatcaagaattttgtagccagtcaaactaagcttcataaacaaaggagaaataagatgcttttcagataagcaagtgctaagggaattcattaccaccagatctgccatataaaagttcctgaagggagtgctaaatttggaaaggaaagaccattactggccactacaaaaacacacttaagtacacagaccagtgacactataaaacaactacacaatcaagtctgcataataaccagttaacaatatgatgacagaatcaaatctgcacataccagtattaaccttgaatgtaaatgggcaaaatgccccaattaaaaggcacagaggccaggtgtggtggctcatgcttgtaatcccagcactttgggaggccaaggtgtgcggatcacttaaggtcagcctggctaacatggtgataccccatttctactaaaatacaaaaattagctggatgtggtggtgtgcacctgtaatcccagctactcaggaggctgaggcaggagaatcacttgaacctgggaggcagagattgcagtgagccgagattgtgccactgcactccagcctgggcaacagagtgaaactccctctcaaaaaaaaaaaaaaaaaaggcacagagtgacaagcttgataaagaagccagacccaactatatgctgtcttcaagacacccatctcacattcagtgacacccgtagactcaaagtaaaaggatagagaaaaatttaccaagcgaatggaaaacagaaaaaaatcagggggttgctattctaatttcagacaaaacagattttaaaccaacaaaaataaataacacaaagaagtgcattacataatgataaatgactcaattcaacaagaatgcctaactatgctagatatatatgtacccaacatggagtacccagattcataaaacaagttcttagagacctacaaggagacataggtaaccacacaataatagcaggagatgtcaacaccccactgacagtatcagacagatgatcagggcagaaaaccagcaaagatatttgggacctgaacttaacactgaccaaatgaacctgacagacatctactgaattctctacccaaaaacaacagaatagacattcttctcatttgcacatactccaaaattgaccacacaattggccataaaacaatattcagcaaattgacaaaaaaataaaattataccaaccacacccttggaacacagtgcaataaaaatagaaatctttactaagaagatcactgaaaaccatacaattacatgaaaattaaacaacatgctcctgaatgacttttgggtgaatgatgaaattaaggcaaaaataaagaaattgattgaaattaatgagaacaaatatataacataccagaatctctgggacacagctaaaacagtgttaaaaaaaaaagttcacagtgctaaatgcccacatcaaaaagttagaaagatctcaaattaacaacctaacatcacacctagaggaattagcaaaccaatcccaaagctagcagaagataagaaataaccaaaatcagagctgaactgaaagaaattgagacacacacacaaaaaatacaaaatatcaatgaattcaagagttgatttttttaaagaataaataagactgataggccactatctaaactaattaaaaaagagagaaaattcaaatacacaatcagaagtgacaaagagacattatcactgaccccacagaaatacaaaaagccctcagagactattatgaacactgagaagaaactgataaattcctggaaatatacaacctcccaagattgaacaaggaagaaactggaaccctgaacagaccaataacaagttctgaaactgaattggcagttaaaagcctaccaaccaggaaaagctcaggaacagatggattcacaactgaattctaccagatgcataaagaagagctggtactattcctaccaaaactattccaaaaaattgagaaggatggaatccccttcaactcatcctatgaggccagcatgatcctgataccaaaacctggcagagacacatacatacacaaaataaaacttcaggccaatatccttgatgaatatagatgcaaaaatcctcaacaaaatcctagcaaaccaaatccagcagcacatccaatagcttatccactatgaggaagtaggctttatccctgggatgtaagattcctttgacatatacaaatcaatagatgtgactcatcacataaacaaaagtaaaaacagaaattacatgatcatgtcaatagatgcagaaacggctctgataaaactaatatcccttcatgttaaaaaccctccacaacttggcattgaaggaacataccccaaaataataacagccatctatgacagacccagagccaacatcatactgagtgggcaaaagctggaaacatcccccttgagaactagaaccagataaggctgcccactcttaccactcctattcaacatagtactggaagtcccaactggaacaatcaggcaagagaaagaaataaaagatgtccaaataggaagagaaaaagtcaaactatctctgtttgcagacaatataattttatacttagaaaaccccatagtctctgccaaaaagcttcgtgatctgataaacaactttaacaaagtttcaagatacaaaattaatgcactaaaaccagtagcatttctgtacaccaacaacatccaagctgagcacaagatcaagaattcagtcccattaacaataaccacacaagcatacaaaataaaattcctaggaatagagctaaccagggaggcgaaagatccctacaatgaaaattacaaaacactgctgaaagaaatcagagatgacacaaacaaatagaaaaacattccatgcttatgataggaaaaatcagtattgttaaaatggtcatagtgcccaaagcaatttacagattcaatgcaattcatgtcaaactatcaatgacatccttcacagaattagaaaaaactattataaaattaatataaaacccaaaaagagcccacatagcccagatcctaagcaaaaagaacaaagcaggagacaacatggtacctgacttcaaactatactacaaggctacagtaaccaaaacagcatggtagtggtacaaaaacagacacatataccaatggaacagaaaagagagtccagaaaaaaggccacctacctacaaccatctgatcttcaacaagctgacaaaaacaagcaatggggaaaggacttcctgtgcaataaatggtgctgggataattggggaactatatgcagaagactgaaactggacctcttccttacacaacgtacaaaaatcaactcaatatggatcaaagacttaaatgtaaaaacctaaatctataaaaaccctggatgaaaacttaggaaatatccattctggacataggccctggcacagattttatgacaaagacgccaaaagccattgcaacaaaaacaaaaattgactaatggaacctaattaaactaaagagcttctgcacagcaaaagaaactataaacagagtaaacatacaacccagagtatgggagaaaatatttgcaaactatgcatctgacaaaggtctaatatccagaacctgtaaggaacttaagcaaatcaacaagcaaaaagcaaataaccccatttaaaaatgggcaaaggacatgaacagacactttttaaaagaagacatacacgcaaccaacaataataataaaaaatgctcaatatcggtaatcattagagaaatgcaaatcaaaaccacaatgagatatcatctcacatcagtcagaatggctattcttaaaaagtaaaaaaataacagatgctggcaaggttgcagagaaaagagaaagcttatatactgttggtgggaatgtgttagttcagccactgtggaagcagtttggcaatttctcgaagaacttaaaacagaaataccatgtgatccagcagtcccattattgggtacacactcaaaggaatataaattgttctaccataaagacagatgcatgtgtatgttcattgcagcaactattcacaatagcaaagacatagagtcaacataaatgcccattaacagtagactggataaagaaaatgtggtacatatacaccatggaatactatgcagccataaaaaagaaaaagatcacgtcttttgcagcaacatggatggagctggaggccattatcctaagtcaactaatatagaaacagaaaaccaaataccacatgttctcaattataagtgggagctaaacattgagcacacatggacacaagggaacaatgacactgtggcctacttgagggtgagggatgggaggagggtgaggactgaaaaaacaggtactatactatgcttattacctgggtgatgaaataatctgtatatcaaactcctgtaacatgcaatttacctatatatcaaacctgcacatgtacccctgaaacgaaaagttaaaaaaagaaaaaagcgttctctgtatgggtgctggagttataaggctgcctgaaatagggtaaaaggatccaggggacatagctcagaacctgggttcccactcattcctgtgatttgaggccatcgcaccctcagtctaggtcttggttttcccagctgcagagcatttgtttgttcattcagtgaacaaaaagtactgagttcctgcttggagggggcgcagggttggatactgaagatagagcccggaaggagccacagtccctgggccagacagtgtctcaaatcctgtgcagttctgttgttctccggctcagaccctggaatgctggggcagatgtggatgactggttctttactccatcttccctcaccatctcaggctgtcccacatccacctgccggctggcatccctggcagaggcttttgttggcttttcacaagccagaagggctgtggaactgacagagcttctctccagggtggactgaagagagctgatgccctaatgcttcctgtgagatgatgcagttgtcttcccccacagtctcccagagttccccagagaatcacactgcaggtgcccacagcaggaacttgccctgaaatgcactccatggctgcctgcctggccctgcctgactcagtgcccactccctcctgatgtctcctgggatcaccccccaaacagactgccttcactggaatctgtgtcttagggtctcttggagaaacacttcccagcttttcaaagtcctgctatcccctccactgaagcctactctggcatgccctttactgaactcctattggtttctaatctacactgccacggtacctaggggaacaaacttattgtcccagctttaaaaataggatgtcccatgtctcagaaaccccttcagagtcagcaaatcagagcagttggtcactctaatagtatcacaatttaattatttcttgattacctaaaagggtttattgtattatgatatggggagaaagaacatactgagttgtaaatggttctgagacactaaattgatctgcatagggaagcactgagtagaaagaggggaggtgaaagatggaaaggtacagaggttcaaatatgaagtagacctgggggcatggagtgggcaggagctggactttggcggtagcttgatactttagcaatgctgaggttaattgatgctgtgaacgcatttcaacattagtgtctttgtgactgtctagggttctctttgttaatggactgatgtttccatgcatgcactttatcaaggctgctatggtggaaaggggtggcatttccatgtttatcagggtttttcctttgcattcccttcattctccctcataaaagtccttgagtgtggcactgtccattttattgatgagtagagacactatgctgtttactttccaaaatcagacattttgagagtgtaaggggggatggtattaatagtcacgtcaggatgtcaggcataatctgagagtgtccccggcaaactactgatgagggcacaaggtaaaaactcttagctaaggtcccacagctagtaaggcagaggcagaggtggaatgatggttaatattgagtgtcaacttgattggattgaaggatgcaaagtattgttcctgggtgtgtccgtgagggtgttgccaaaggagattaacatttgagtcagtggactgggagaggcagacccaccctccatctggttgggcaccatctaatcaggtgccagtgctgctagaataaagcaggcaggagaagatggaagcactgacttgctgagtcttccagccttcatctttctcctgggctggatgcttcctgcccttgaacatcagactccgagctcttcagcttttggactcttggacttacaccagtggtttgccagggactctcgggtctttggccactgactgaagggtgcactgtcggcttccctatttttgaggttttggacttgaactgatccaccactggcttccttgtgcctcaacttgcaaatggtctatcgtgggactttactttgtgatcatgtgagtcaattctccttaataaacttgttttcatatatacatctatcctattagctttgtccctctaaagaaccctattataggtgggatttgaagccaggtctattgggctgtccacggggtcctctccgtcaaggtgaacaccttaaacaaacacatctaccatgtgctgaccacctacagtgtggccttccatgcagagctatattgactggtaagactctttctaggtaggtggtcttatctccaatttacaaatgaggaaactaaggcccagaaagatggattgcctaaagtcattcacctaatttgtggtagagatagaaattgataaatggtttttctcctataccagccatgaggccaagtgagggagcatagagactgaagcccttgttcagattaaaacaggagatcctgagggtgacagaacaggtgaagtgaggtctgctttaagcactctgtgcacaagtgacctcatcagcctttgctactgtttctgacttctcttggaagtttcttccagtgaaaagtgagcttatttttcttttccaggtgtcttcctccaacttgcacagcctgcagctcctattgctgtcacatatattaatgctgatatcaaagcccctgctggaagtcagggagcgcctgctctctttgcagaaccggcagccccaggtgtgctatctttccccagttggctgtgacaagcggcctctgcaaggccgaaccatttccagatccaaaagctgaataccccttggctgcactcagcccccagctcctgagggtgtggagagcaaaaaccttcctgctgagccctgacagctgctcagtctgggcccctttccacagcctggcttcttcctgccaggagaaattcatcttttcacagcagagggagtgagaacagcccgcagttcctgttggatggcacctgctatctctctgccccctgggtagtaccaggcgttctctgtgggaaatgcccttcctcctccttctcctccctccctgtctgcctgaaaaatgactcaactttttcaattcactgcacatcactacctcttccctgccttcgaggctgttggggtcttcctctgttcccacagcccctgcccagccatctggcacagcctcctgcacacagaaggacactacttgtcatccttatggattcatgagtggtgaagcgacagacctggcacagatgaggtactttgtgagggtgttgaacgaagatggggagatgaatggatgggtgtgggaacacatgaacaggagtatttagaaatgaattaacgactgacccagtaaacaaacgaacaggtgaaggaacaagaactgatgagctgaaaccctgccttccccaggacaggactgactttgaacttggcttcaagactcattcatttcgtccctttaggagtgacgttgtccctttcagggccccacctttcccatctagggctggacttcaggccagcctggctcccttgtgcacctcaattgatgggcaactcattcctttttgacagagagtccagttttctgatggagcccaaatatgagtatcgattgtctcccaggcccctgatcagatatcacaaccccgggaagtcctccctgaagcctgaggctggtgcatgcatcttcggagctgcgatcatgaatgctgaatgacacacggggcctttgtaccagctgctcctctgcctggattgctcatgcgcagatgtgtgcgtggctgcctccttcttgtctcctgatctctgctccatgatcaactctgtggagaggccttccctggctaccctaagatagcattttctccatcattctcctcctcattttgcatgacttctcttctgagcacttattgctacacgtattagtctgttctcccattgctataaagaaatacctgagactggtaatttatattaaaaaagaggtttaattggctcacggttccaacaggttgtacaggaagcatgatgctggcatctactcagcttctgcggaggtctcaggaatcttccaatcacggtggaaggcaaaggagaagtgaggtgtctcacatgatggcagcaggaacaaaatagagggtggggaggtaccacacacttttaaacgatgggatctcatcgtttaaaatgatgatagtgagaactcactatcacaaggacagtacaggggggatggtgctaaaccattcatgagaaatccaaccccatgatccaatcacctcccaccatgccccacctccaacactggggattacaattcaacatgagatttggtggggacacaactccaaaccatataattacattatattttcatgtgtttacaataagcctccctcaacagaatgtccattccttgagggcagggattttgtttgtttgttttgctccatgcactgctccaatttctacattatctgccatataggggctcctcttggcatatggggcctctataccaatagtttctggtataggggctcaataaatatggataagtgaatgaatgaatgaatgaatgaatgaatgaatctggctgtgtcctcatccggagagtcttattcatctttgcatcccctgggtctagtatggaaccaagtatgtcgtaggtgcttaaaaactacttgctgaattaatgattaaagtacagacacatctttcacattttgatcaaatccttcctctgcttcaaatctccaatggcttcccatggtattgaaagtaaaattcctgattccttaccacggagttatgagatcttctatcctccggcccctactatccttccaacttcatctctttcctttgctaatatggaacatcataatattccaccccaaaacacgaagaactgttgagctgaaggcatgtaaaaagaagtagatgcaggaaggctctctgccttccctctatttgcctaaaagcaggacatagatttacaaagacaagagatattctgctcccaccctcttctgccagggagaacaaagggtaaccagtgaagacaactttggatgcttataggtctggagcttacaccagaggaacctacatgaaccagtttccctaacccacctcgatctgctatttatttgttttcccccaagttgctgtcactagagactcaacgttcttttcctttgtcttgttgcttctttcaacatttactgttctttctcgaagctggaatttaaagccacttctttgagcactactcattccctgggtgtctcccatgtatgtgtgaaatatacatgttaataaacttctgtattttttttcttgtgttagtctgtcttttgttacaggggtctgtttcaactaaggacctatgagggttgaagaaaatatgttttttatcccctatgctaacaacactgcagcctttcctgagccttccaagcgagttcctgcctcaggacctttgcacattcttcccctacatcctcacagggtggcttccttctcagacccaagtcctgcctgcagcgctagcttctcacggaggcccttcctgtccatatcacaaaagcagtcctctcctcccatcaccctagccccttaccctgtttattccttcctagcactggtcagtaatcctcaatatttattagcttaccagtaatggctctataaatatacatttgtagtggcctgtgtcattcgctggggtatctcctgtgcctggatcaacataagaagtgcttgattaatacttttaattaacaaatgctcttgcctatcaaccttgcttttccagctcctttctattgcattggacaataaagcacaatgaatgtgccccgcccagggaggccaactgttatcagtgtacatgtcttcttgattggattatgagcttgacggggaccgagaaatgtctctgactctacttctgtgtcatcagtacagagtgtagtacctgatacatagtatgtgttcaaaaattttttttgttttgagacagggccttactctgtcacccgggctggagtgcagtggcatgaacatggctcactctaacctcgatctcctgggctcaagccatcctcccacctcagcctcccaagtagctgggactacaggcatgtgccaccatgcctggctaatttttaaattttttgtagagatgaggtcttgctacattgcctaggttggtcttgaactcatgagctcaagaaatccttctgcttcagcctcccaaagtatcggagccactgtgcccagctaaaatcttttgttgaatgaattaatttggggcatgactgagaatatataaaaggggaaaaatgactgtgaatgatcagcatatatttcagaaaatcctgcattaaagcacatgcattagtttcctcattaagacagcctccccataggccctcttaaggcataattctgacaagcttgattttatattttaatctatattttgtttcaataaagaagttgggcatgcaaagggaagcacctaaggggtgagagaatgcatgtccgctgaccactcttttgctcgctagacctgatgaatgagacttcacagtggggtgagaatttccatcagaggctatgtgggaacaagagtgactttactttaaatgctaatccaccatgtaacttctgactaaccccacgtccaggaatgcctccaagaagtcgagttgatgtattgctctttatgtagaaacatctattcactgtaagtttcctccaaaacaactcttgatgctgttgcagaaatcaaagactgtgatgcctgcagccacctacacattcctcccagagtgcatacactttttccccagatctaggccctgggactggggggttgccatacagagatctacctgtcttgtggcttcccaagaccatgcttcagtctgcaagttcccctaacaaatcaccctataccatcagactggacttgtctgcccctttctttggtttcttggcttcttctttgccatttggggattgctttgtgtacacagccatttcaagaaacaggctgccactgtcttagaaaaacaacccctggcacatccagtgtgatgccctctcagaaccagttttcttctggaaggctggtttgatttagccaagacactcatgtccccaaagcttcttgacagcagaagtgacctcctgcaagtgcccagagctgtagagctggaggggagctgccccaaacagccttctgctctccaagggcgattccatcagggttagtttccctaagacagaaggcagaaccacagcttagggaaattcttatcatagtcgccatttcttgagtgctttctatgagttggaactttattgtccacctttcagagatttgttttaaactcagaccctgcaaactgtgcatcatcttcatactatagatgggacctggcttaaggtcacacagctgttaagcagggtcccagctctccaaacccaagcctggaagagtacaaattctgcagcttctctacaagctatccatctgggaagcataaaagagagaaaatgccatttcatatttccattttcttcctgtccttgtatacttagagcataaaggatgctgtggtagacagaatataaccccaaaccctgtgcctgtgttgtctcgcatggcaaaaggggttttgcagatgtggttaagtcgaggatcttcagatagggagattatccttgattattctggtgccttgggcatggtgccttggccaggtcttggctggaagccaggagaaaggttggagtaccacctgcttccacctcttctgagctgtgagcatgaacacttgagtaccccactttttgactcacaacccacaaggtttgagaccaacttgccccaaatcacacattaagaaggaggtggagccagactggtctgagtcccaagcctatgcttcttccaaaacaccaggttagaacagcggttcatagccaggagtgattttgcccccagggaacatttggcaatgtctggagacatttttggctattacagctaaaggtaggtgcacctatcagctaatgtgcagaagccaagaatgctgctcaacatcagaccatgcgcgggagagcccccaacaacaaaatactttccagttccaaatgccagaagtgctgaagtcgagagaccctgtcatagatttttctctagtaagtcatgtaatggcatcattaaactatcacgtgctcatccttttggtgggtttgtgaacaaaacaaatttgtatgagaccatttatcatttctttctagaactctgaatttataatttatattgttacagagtacatttaaatctgccttaataaaggcaaggaggcaaagaaggaaattcaaactcactaagcaccttctgtgtaccaggcaccatacatatcgcttagcagtctttatatagttcttcttgcataatagctctcaaggtggaggcttagggaggctggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcaggaatctggccccggggcccatgatttgccattttggcaaacagagcatttcaaagcatatggctcccagacgcaaggatgtgatacagagaagtgaggcacagccgagcacttcacccaggacccctctgcctccaggtagtggtttcattcctcaagccattcaggagggcaaggagggacttgtggcatgggggaaagggccccagtccttgctttgatactgactgcaatatgcagggcccgttacttattccccagctttctcatctgtaaaatgggtgcactgatccaacagaatggatatgaacatggatgctaattactattgtattattattataccattattattattaatattattattattattattgaaagatctggctcagggcagctcccctctgttgagaacactctgggcacacctcctccaatatgttaatccacacaacagcccatgtgatcatttgaaatagaattgagatgaagtctgtcctctgatgcaaacccgccaagcgtttcccattgcatttgaaatccagctgctgaactgaccaagctctgtggccatggagtttgcttccttcctgctctcttagttttccttcactttgaccctgttgattccattccagtcacacgtgcctccttgttctttctacaactgcccagtattcacgctcatgtcagtgacaacccgagaactggggaaggaagatggggctgagacctgggatcccaggcaaaatggcacatccatggatacggggacgatgctgccattactcctcctaaggcaggagctgtgaggaaagcagtggcagccagcaccttggacgtactccccatccatgcgtgtgagctgcatctaactcgcttcatgtatgttgtctcctcacagcacctagcacccattttacatgtgggtaaactgatgcatgagggtgggaacaggccagcaccactctactggttgcatggagaattccaaccatggtgggtggactctgagctcacagtcctccccacttcatgttggctgtctgggaaaatcatcttttgttctttacacatccacttttggagcctagaatctcctgaatgctggtcacactgctcccaatatggggagacgaacagtagtccttcaagaactttttgtcagcgtgaatcttgcctttcctcagtttaacagaaaaacaatgggcagcgtgtgaatgcaatgggcacttttccatcctagcagtttatttttgacacctcacagaagtgaatcattgtcatgtaactacatctcatttgcaaaagtacaaattgaaacagagttaatgccaattccctcagcttccataagagcttggtaattaaagctgctaaagaagaaagaaagtagacgcagtgtttccttcaaggcctggttccgctccccaacccagcctgcactctctgcagccatgtgggtttctcatgtcagctgaggcggctggagtagaatgtctccctttctttctcaactaactcttgagtttcttgtgaaaggagataatgcaggtaaagtacttaattccatgcttggcccataataagtactcaataaatagtattggtgataatgatgataatgatgaagaagatgatgatgattattttgacattaggaatggaagagaaagcggagaagcagggaagatttctgtagagatagacgggcggctattgctaagccataagcccctttccctcgccccatcatggggagtacaggggagcctcactcaacccaagcctgggaagagggactcacactaccccctgagagctggggacaccgtggatggaggtctgactgcctgactgcctgggagagagatgggctaatgatcaactgcttaaaacgatgtaggggttgaaataatattcctgagatctaatggactgcccccctatgcaggggactaaacattaagcctctgcatgctgatcccattctgtgaactggtgggagtgaattcacacatgcaactcacatgcgtgccccccccacccgaggccctggaatgcactgcccagacacactcaattacaggcctctgagaacgtgccttgcacagtcacacctcggcaattctgcccatgctgacttctccaccaggcgtgtctttagcctctgtcagccttggagctgaaagatccccaagtggtggatttgcgcctgacccgggatagtcccatgccctcctctgttgtcctccaagccctctgctatgttcctgctggagaaagcggtctgttctggtgggcattagtcaagttccatctgtctcccttaccagagcgccactcatctctgatggggccatgcccagaggaggggctcaggagtgttctgacctcagagtcgcctggcagtgcagcctggtgccttcactagtccactgtggcagggcaggcagctgttcccataaactcccttgggcaggtggcccatcatgtaattagaagccaggtgacctgataataatcaactcctgcctggctggaaagcccttgactttaaagcatccagctaaccagggcttcttccccagaattgtttactaccctgaaggggaaatgctatccacccatttatttcaattgggtacctgcaccttcataaaatggcataaactaaacaagaaagtccctagagtcctctgcaccccagttgtcacctgttgaggagctcatatataggggatatgagaagtgaattgtctgtggagctgacagccagcttgaagctctccctctgtcaccccaggaacccccatacctgtgggattaactgagcgcttcataagcccagagcagaacttctcccctcagcaattttgtgacgaatgctgaagattttggaacataatgtttattttttttcaagtttgaacattgagataactaagtcagttcatgtttgcattacattttgagcagtggtgaggttcccagggggagaacagctctgtgtctgcaggaacaccccccaaaggcatgggttctgattccctctagggtcaaagttgctgacatataaaggggaatgttttccttcctccaagaggttattccctgctcagccaggctccctgatgtttttattttagtgtttatttaacccacaagtgaagacaatgaaaatggtcaactaaattctatgtattgacagagcctattggcaataatgatctcatttgactctcacactaatccgtaagacagagacagtataagtcgggatctggacttttccacagagaaaacggaggctgagaagtggatggaacgggggagtggtctccagcctcaggtctcagcatcaacctccgtctccacccagcttctagaatcaattctcacatgcaaacctggtcagtccatgcctcctgcttaaaacccaacagtagcttcccactggcttcagggcagttctacacattaaggccttctgtgttctaatttctgtctacctttgcactttcaccagctgctggttcccaattccaggcacagtgtcagtctcctgcctctggccctgggctcctgtgctcctccttcctcttacaatgccccctcctcacatttgcccagtgaactcctccctgctcaccttgctagaccacggccaaccatttcctgctctgggactcttatctgacacaccaggcagatgggatggcttggcaatatgtcaattattactcttatttgattttacgccaatctttctcccaagggtctggtggctgtcctctgctcatctctgtagcttagacctagcacagtgactggcagacagtaagtaggtgtccaatagactaggatctaacttgaatgaactgtttttggtagaggaggccaaagtgtttatcaaagcatatgagaaaacagatgcttatctctagtccagtgcagtgggctgagtggtggccccacaaatatacatccatgtcctcatcctggagtgtgcaaatattactcaaatggcaaacatatgattaggttaaggatgttgagaggaggacctgggtcctaaatgcaatcacacatgtccttgtaagagtgtggaagatggagttttgggatgcacacataggggaaggcctgtgaaggtggaggcagagactgtgtagtgatgtggccacaagccaaggagcactggcagctgccagaggccaggagaggcgtgtggaagggactcccctcagagcctctgcaggggcactgcatccctactgaagcctcgatctctgccttctggcctcagaactgtgggagaacacattgctgtcatttgtggaactttgtcacagcagccacaggaaatggatacagcccaacagaggactgtgttctcaccatctcagcagctgcaaggaataattaagtgacaaattcctcagctggattcccagggattgcccaagtgacagtgaagaggaagacagctgctgacagaaaccacgagaaagacctatgagcctgacaggtgtcactgatttcaaggactgcagagccagttttgaggttttctacatttctgttgaaaaccccagcatacgcaccaaaactttgaagggctcaaaatctttctcagagcagcatttgcttggactgcttctgaggggagaggttttctggagggttttggcaaaaaatcataaggaacactgccacgttttcgcattcaagtttcaggcgataagctcactaattaactctgccataggctgcgggaaagtgataagtactaaaaccgaacatgtgaaaatgcaagggagaacggctggaaaaaggagactttggagttgggcaggcatgcgttcaaatcctggctgggccacctaaactatgtgccatgagatgtggcccaagcagggctccctggagctgtggtgtcctcatggggagaggagggtctccttgcggagactttgtaaggattagggtgagtgtggccaagtatctagcgctgaccaagtgcttaacttaggaagatttttttggggggtgtgtggggtcttgctgtgtcaccccagttgcagtacattggtgtaatcttagctcattgcaaccttcaactcctggactcaagagatcttcctatcttggcctcccaaagcattaggattataagtgcaagccactgtgcctggcttggaagataatattattaattttaaaagttccctggtcttcttgaaaaagcagaaagtgcaccataaccttggcaggcagcttgcccactcaccattgtttggcattaagagtcagatggtggaaatcactcatttccaaagccctggtaccctgcatctacagctatgtagaggattaggaaatactttcctgccaacttagtggctatattcgttttctagggcttctgtcacaaatcaccacaaacatggggtcttaggagaacagaaatttattctgtcattgttctagaggcagaagtctaaaatcaaggtgttggcagagttggttctctctgcagactctgagggagaaaccatccacgcctctctcctggcttctggtgctgctggcaatccttggtgttcctttgattctagatgcatcgctcgctctaatctctgcctccaccttcatatgcccttctcttccctgtgtcctctccttgtcttatacggacaccagacattgaatttaggggccaccctaaatccaggatggcttcatcttgcgatccttaactgagtaatctgcaatgaccttatttctaaccaaggtcacattctgaggttctgagagaacaagaatctttgggggatactactcaacccattacagtagctaagagcacaaacactgccaacccactgacttcaggggcacctgccccataaaacctatgagttatgacctctcagaaactcagcccttcatgtgcaaagtgggaataagatggtctgtctcctgggctgccatgaggattgaatgaggtgaattgcacagccacaaggttggtagatctggccaccaattctggaggcttccatgctcaggaaagtggcttgggctgggatggctgctgaggaatcattcaggaaatatgtggaaatgctgtccctaggcctcctcagcagaacctggatgaggtccctcctcatccagggacccgggtgggggatgtttccccagggaagggggttctgaagtgcagccatgtagttagagagcccttaatctggttcatcccctcatttcactgatggtgaaactgaggccagagagggacagggacttgtccaacttactgtagattttgggaaagtcacagcaaaattccaagagcatcccagaccatctctcctgtgagttggggcagggtgcagtgggatgtggtacctctgtgtcctggccaggaatgagggctcagaaatgccatgaatgaaagtcacattgtcagctcaaggtcaattcatcaaaaagcaaagactggtaaatgcatttttgaataaaaatatgttaacaaaagaaacccagtctgtgaatgtgcaggaatccctctcactatctgaacctttgctatccagactcctgttttccaaacgcttgaatgaataaattcgataaatgtgttgctatatcgcttgctatccaaatcctatttcctgttgtatgcataaatttctggaataaaatggatttggaaagggaaagatatatatattctttttgtggataaaagtatattttatgccacttggctgaggcttctctctgtttactaacctccagctataacaacagggaactgaagcagaaggaacaacaacaaaaaaaacattctacagaattcactacgcagacatgatgaagaacttagaaactgatcaaagctgttagaaccattccattctatgcacaaaaatgtacattgttcataaatagttaaaagagataaggtaaatccagcaaattgtgtttctctatgatttgactttcagcaatgtgacctctcagtgcattgacttttgatgaattaactttcattaagttgctttgttttcttcacagctaacagctagaggggtggacccttggaaatgaccataatatgttgagactgctggaatggtcaaggtcttcaacattcccctatagcctttttgcaccatagcaatttgtgtccttattgaacattcctcagaatactccagtttgagtgtaccatatgttcccagtggggaccctgacccatgactgttattgaaggtaagatccctaagggcagagactctatgtgtgtgcacatgcatgtgagtgtgtgtgtttgtgtgtttgctcctccactgcatctccaggcctagaaggaggcccactttctagtaggctctcagtgattatttgtggaatgggggtaagtgaaggaaagcccataattctcatctcttgcctattctacagttactgcctccaggcaattgtagaatagccacagttctttgcagcccctccaatgggagggaaagtctttccccatcccttgaatctgggcgggctttgtgacttgctttggctgatagaatgcagcagaaatagtgtggagttccaagcccaggcctcaggcagttttgcacacttccccttcttttcttgcaactttgccaccatcatataaacaaacctggtctagtctgtgggacagtgatggacatgtggtcaagttacccttctcagtgccagaccaatgagtgaggctactttggactagctggtgcccagatgacctgccagctggatgtagataggaggaaatcatctagctgagatcaaagaagcctgggccagaagagcaaaactgccacactgactaactcttgcgagcaataataactggttgttgtttaatccatgaggcttggcggttatttgttacacagtcatagctaaccgatacaaattccttagtgatctttctgaattcactcttcccaagcctctcccatattccacattttacctctggtttattccctcctctgcagactttttaaacaccagtgtgataatgctatgtcccagctcaaaattctttggtggctgcccacttccacaaggacaaagtttaattatttcagcctgtgaggcccacgatgatctggccaccactttccctgcaccctgatgtcccctgaggcccttttactccagagcgtctctccagttttacatgtgtcctaggcttccattagcatcctctctgatgtctgtcctctactcagacattcctccttttccctttagctggctacctccaggtccacttctagctcaaatggcacttttgctattaaaaaaaaatgcccctttctcaaataaaatattttacaagttagtacattattgaataaacagaatgatcacaccctgtggccaggcccagccttgccaggggagttctccagatgccctctctgatggcagcagccctgcagatgcacatgtgtacccccacagctgtctgcttaccccacccgtgagccagtgtacacctaagctctgtgcccttcccacaaagtggagcaccatgccagttttggaaccgcgcagaggatgagaatcaggcctctgagagtgggctagaaaggaagctcagaggccatctggagaacggagtgcacatgtgtgtatgtgcatgtgtgtgaatcagtatatgtggatgttgtgtaatcccagctgtgtgcatgactgttttgcttgtgagttgatgtaggagatggtgcagtcctgttgtgtcagaacctggctgggagacctcacatccccacatcggcacccatgttctcacaggttagtgtctaaggtgggatgctgtgtctttagaaatggccataagttagtgtctgtctaatgtgggacgctgtgtctttagaaatggccataagttagtgtctgtctaatgtgggacgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttactctctgtctaagatgggatgctgtgtctttagaaatggccataggttagtgtctaagatgggatgctgtgtctttagaaatggccataggttagcatctgtctaagatgggatgctgtgtctttagaaatggccataggttactctctgtctaagatgggatgctgtgtctttagaaatggccataggttactctctgtctaagatgggatgctgtgtctttagaaatggccataggttactctctgtctaagatgggatgctgtgtctttagaaatggccataggttagcgtctgtctcagatgggatgctgtgtctttagaaatgtcttcttgtgcagtgcacaccctgagaacccatacttggtggctctgcttgctctgactcgatatttagaaatcagtctaagttgtacctcctctaggtaacctgacatccattcacccagacacacatctcctctgtgctcccttagtacctgggacctgcctttagcttagttgcctattgtagaccttaagaactctggctctggagtcaaactgataggaagtggaattgtggttcactgctgtgtaatccaggtaaagctcttaaccgctctgagtctcaacttcctctatccacctccccttttccccccagtgacaaagccaatgactacttcttcctcttctttacttggaaactgaactccaagctcctgattgggacatttcttattcctctttgtgctcccagggctgaaggactaattacaatgttattgacttaacctccattggcactgggcattgccctgtaaaaggacatcagagtgtggggtctgacatggggcaccaaacaaagccataggcaagagcacatcacattgttgaatttgcctgtttggttctcagaatctcaaaatagtttttgataaaagcggaaatgaatctctgccatgctttgtcgacaggggtgagaactggttcttgggaggtggcaagaagtcttaaatatcacaatggtttgcagagctgcaaaagcttagccctacctgatgaaatcttacttcttagtgtttatattcttctgttatggagaaatttaatgaaaattagtttacccctgaggtggttgaagcttcccactgttgttcgtcccaaggggcctccatctctctctggttccctatccctacccacagggctataaatagtccattcacagaactgcttttaaaatcctggcagtgcatgcttgtaatctcagcactttgggaggccaaggtgggaggataacttgagcccaggagttccagaccaggttgggaaacatagcaagactctatccccacaaaaaaatttaaaaagtagccaggtatggtggcatgcacttgtcccagctactcaggaggctgaggtgggaggatagcctgagtccaggaggtggaggctgcagtgagtcatgatcacaccactgcacttcagcctgggtgacagagcgagaccctatctctaaaacaaacaaacaaacaagcaaacaaacaaataaaaccctcttgactgtatctcctgattccctgattcctgctggacctggatgaaatttcacatttatataatagtttagagttcacagggtagttttagatagctcatcttttaagtcccttccctaaaagcctgtgtggtaatgggtgtggagtctgagtctttgtttctagacagggactagcaccaatgctggagttaattctcaccttctgtacgaattcattttagagacattgatgtgtcctgagcaatggctactatttagttttaagtctagatttgtgagacatttccatttaattttcattaaacagtttttcaaaaattatgactatatgccaagttggtgtcattatgtctcttaacttatagctatagttattttaatgtgcatatatttattccttctatgcaatactttctgcttggtccggaggattagaaagcaatttgtcattctgctttgcacacaattccctaacttttgaggggaaaggagacatctgattcgactccccctaaagtgctgggatacttaaggtaattggggtgaggccaaggccacggatagggttctttctttcatctattatttgttcattcacttgtttattcattcaacaagtaagaatgtgcccgtacctgcctaagcaccccatcccaggcagggagaccttgctgtctgctggctgagctccctcttggggcagtgcaggctggtgcacagagccctcccacccaacttggggtagtgcctgcccccctggcaggagattcagaggcagacatatctagggttgagtctggactccaccttgcctcttttgagatcatggattcaaccttgctggcatgagagaattgaaagggatcatgtatgaacaatgtttggacgaatcccaggcatttgacacacatgggttccttcttttttccctctcctgcctcctgtaaatccagtaagcaatacttattcattcccaggtctgtctcttctgtgggctcctccagcataggaggagttaaaggactgagccctttcacttgcagggcagggccaggatgtttcatggtttcttctttccagatgttgcaggtgcaggcctggcattgagataatgtcatacaagtgggtggctttgactctttatgttatctgatgctcctgccatcttcctgtcccaggctcttctgggtctgctggacacagcctttaccccttctggatctcaccaggctcctgttggggcacacctgctgtgtgcaatcctaagagcctggctgggattctcaacactgtttgcaggagggtttcctcctcggggtcagccggggccagcagccaatgcagttgagagtgccagcccccttcctcctatagaatgtctatagtggtcattctcaactgtgccctgtccctctcctcttcctctgtgggggtagagacactgtcttgctcatccttttatcttcaactcccagcccagggctggcactgtggcataacacacacacacatatatatatatataaaattgcaatatatatatatttgatttttgtccctagtttttggcccagatttcttaaaagccttgggatttctggagtaacaagagtggcttttgtcatttataatgaacccctaatgtggtgactcaggtgggtcattagatggtttcaaggcagcgctggccatgcttggagggttggaaccttcagctccatcttccagcctctaaggaagggagaggggctgcaggctgagttcagtcaccagtggccagtgatggaatcaatcatgcctatataatggagcctccatagaaacgtctaaatgatggggttgaggtgtttcccagttggtaaacgcactgaagtgctgggaggctggtgtatccacagagggcatgaaagctccatgccccgtgatgcacccccataccttctgtatgcctctcttccacttggctgtttctgagttgcagcctctataataaagctgtaattgtaagtagggcactttcctgagttctgggagtcatgctagcaaataattatcaaacctgagggtagccttgggaacccctgaatttgtagtcagcagagcagaagtgccggctccctgggactctgtttttggttggtgtctgaagtgagggcagtcttgtgggattgaaccctttaactctttctgacactctggggaggcagtgtcagaattgagctgaattgttggacacccagttgttggtggagacaaattgaagaggtggtgtggaaaacatgtgtttggtgtcaaaatacacacacacatttggtgtgagctgtggtggtagaaaacaccacacaccacacagtaggaacttaatgagtatgttttgaatgaattcatgaaaaatacaagcatttattgagtgctgacccactgtcaggctgtgtgtttggatacaggtgatagaaacaaggttcttgtctttgaagcagtccctgatgttaggaggactgaccaaccatggccattgtaatggggtgggggtggggatacactaggagttaatctagggggctgtgggagcccagaggggcgggctgtttctaagaaagtctcaagatgcagtatgagctgactttttgaagatgagaagccacacctcaaatggatgaataagggtggttgttgcaagaggggaaatagcacatgcaaaggctgagaccatgaagcgtgtgtgtgtgtgtgtatttatgtgtgtatgtgtgtgtgtgtgtgtgtttgtgcgtgtggggcagggggcagctgcctgtggctccagatggctgcagtgcagggagaatgcgggatagagagggagggcaggcagggcaggcagagacgaccacataggttctgtcaaatgctgatacgcccctgcagtctttccagaggggtcctttttccaagcaaggtatgtgctgaggcatcttccatcaggaccgctccatcttctggggtgctcagaccttaattcgcaccttgataatggcagtggccttaccgctccatcttgtttgcatctgtccactccatttaaacacaaactccccatagaggacttaacttggtgccaggcacagagtcagggcttcatgtgatttttaaaactggaattgacacattttggcaacgatcttctttttttaaaaggtgaagctcttttattttgcctcatttattagacttccctgccactgccttggggttatgcacacaaataaaatatgcagcaggaaactgcctctcttgttttctttctttgctttcacctaatttcaactccttgtcaagtcttcttacatcgacctgttcctcacagaagctgcctcaggcggcctcctggccctctcctgggagatccatccctcttctttaatcatggagagcaggcccatgagtctctctgccattcagctctgagcatcttcctgccacactttcccgggtggctcccctggggacttgctcttccctgtccacttaggaagatgcaagatggtctcatggtctaagtggcagcttttcttagacaggtaagttccctgaggctttaaactgtacactctcaatgtgagtttaaatgaagcttctaaaccctggtccatcttgtggctaaagtcattgctagccagcgaggcccaggtgctgggtcaacacagggggttgaagatggattgaggaagcggagggcaggggctgacaggtgatctgggattgggaggtgcaggtggccttccctccagggagtcccatagacactgatggggagcccagcatttaaagccctggaaatgcagcatgttctacagtcaaaagaaagccacagttgcaaacacttggaacagaatcaggatcattgcaaaaagtcttgggagggcttaggaaaaaaaaaacagagaaggctaagcttagtgatttttggttagcaaagaacttcaggcagatatgcagatgagtccaatctggcttgtttgtgtgcatgggtggggaagaaggtcaacttttcactcagatacaatgctgacatttaccgtttcttctgggaaaacagctgttatggaaaaagataactcgagaagcattaaatcacaccatgaaacatacagctttcttgccctcatgacctgcacttatcatagtggcaatgcccacacctttgcaggggtggcactgtcccagataactgccctgggctggctgctccaggcccctggctggtgtctctgcctccagtttcttctcactgcaggtctgccctgtgaaattcatgcacacagactccccaacagacctctagtgagttccataaaaccgcaaatccttagtgcaacagccaagacgctctgagatttgcttctagcttatctcctgactcctcctctgtgtctcaccctgcactccggggagtggttcctgacgagcacttagctgtcatcagatgaggcctgaatatcaatgtttgctttggttttctttctaagccaccaagtgatggtaatatattcagccagggtttaaaaactgctctagcccagtggttcttgaacttggctgcaccttggaatcatgcagtgttagaaaatgccaagcctgggccctagccctccaagattatgtcttggttggccttcagtgcagcctgagcaccagggctttaaaagcttcccaggtgactgagcaatgtttgagcaccactgctgtggctctgatggtttatttaaggttcgtttgacatgaacttcttcctatattctggcagtggctgctctcactgcctggaaattcctccttccctacctcaccagctagccctctcccaagttccaaatttcagagctgaggaactatagcaggggttgacacatgtttaaaataaaaagttagaaagaaaatatattaggcttttcaggccacatgtggtccctggcatgcattctttctttcccccttttaaaatgcaaaagccattctttgctggtgggtcacacaaactaggccagggaccaaatctgacctgtggacaattgaattgcctgttttgtgaggcagtgggttccctgtcaatagatgcaatcaagccatggctgaaggaattcctggcagggaaaccatgactaggacttaagcttctgataaatgactgaactagaacatctttacggtcttttccaaacttgggatgccttaattctaattcatctcagcccctggaaggtttcctcatctgccagatgacctccctccagcgctgaagtcattcccatgttgtgttccgcctcagttaattgtgaagatctgcatgtgtcagcacagacttcatttcaaaaccaagtgctatgatttaggtgtctttgaatttaagagacaaagaccaaagattgttcttgacctctgcattgagataatacctgaagcaggaatggctggaaccatgaaaatcaacatgcttttaattcatcctcagccaagctgatctgacaactagaaacaaaagacaaaagtatttctttccacatagacacaaacaggactgatttatgaggatcaagagtaaccccatcctgggaagataaaagcaggagccccctccccttatcctcaattctctgtgtaggccatttctccttggaatagtttttaaccttgcaagtaaatttcaaaatgggcataattccactcaatctttagcaaagagctgaggttctaggacaagatggtgaagatttaaatctagcatttgcctcttagctatgtgatttgggaaaaattactggatcattctgaatattggttttttcatctataagaggccgaggcaggcggatcacgaggtcaggtgatcgtgaccatcctggctaacacagtgaaaccccatctctactaaaaatacaaaaaaattagccaggcgtgatggtggacgcctgcagtcccagcttcttgggaggctgaggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatattcacaatgtttttagtgggctatacctggtctacttagatggtaaggtttagctatggggctagcttgctggaaaatgtcagtgttagctgaaaaattatctgaatataaaatgcagaaaatagcttctttcatggaagtgatgcatgtatgtcctttttagagccctcatatgttaaatctggacaactatgcatcctaatgtggcaaagaagaacagcaagctatctacacacacacacacacacacacacatacacagatttgaaaatctgactctattatcttatattcacctagtatttttgtgaaaattaaagcacttagaacagggcctggaatagagtaagtgatcaataaaagttattaccagagactggatttggggacagatgtgaatgtgctatggaaagtccagggtagtgtgtagaggtgaatttcttatgtttgtcgtggaacgaaaacagcatagatttttaacacttgggttcacatcctagctccaacactcactagctgtttcttatcaggggagcccctaacccctgtggacttcagtttcttcatttgtagatgagagtggtaatcctaatttgcaagcccatcttgcacagtaggggtgatgtatataaggcagctggtgcagtgtctaagttaaagttgatgctcaagaaaggctagtggctgaatgccattatgagtggaaactgagcaagtgcggcaaggactgggcaaagaacaggacagagcctgggaagccctaagccactgcttctgggtttaaccaatcactttaagggtgccctgtgggttcagcacctcccagtccacatcttacagcttagtgcctactcagccccttctatctgagttccctggtcatgattaaaccacctgcaaatacgtcctgacaaccttctagatgtcaggccaggactgggcactttaggagaggctgatgtaaaagtgccaactctgcatccagggctggccatgggacttgtcatcaccactggaatacgagtggagaagagggtgttaccccaggtcagggctcttaagaagctttctgcacagtctttctccttttcacctactggatgcagtagaccagagacactcggggttggcagagccacagcccaggaggaaactgggtgcatgtgctcatctacctgggacactagccatgggtggttctatgagtgagacatggatttctattgtgtgaagcttctgtcattcagagacatatttgttaggcagctagcgttacactgactgatacatgctgttagtgactcagaattcagactgcacatgtgaaacattcaaggtgcctgctcaggagcatgttacttttttaaacaatttttttagaaaagagatgggctttttttctctagcaccctggctagagtgcaatgctgccatcatagctcattgtaacctaaaaattctgagctcaagtgagccttctgcctcagtctcctaaatagctgagattacaggtacattccactactacacctggctagaaatgtttttttttttaattagtaaagttgggcttgaagatacaagaccattttttggagggttggcaattaagaagccattggccatctgtgcaacagtgtatttgttggatggaggaaagtgtgggagaatgtatgtgataatagacaaacccttcagttttgactttaaggtattaaaaacctggttctcagaaataccatttgacccagcaatcccattacttagtatatacccaaaggaatataaatcattctattataaagacacatgcatgcatatattcattgcagcactattcacaatagcaaagacatagaatcaacccaaatgctcatcaatgatagactggataaagaaaatgtggtacatatgtaccacggaatactacacagccatgagaaggaacaagatcatgtcctttgcagggacatggatggagctggaagccattatcctcagcaaactaacacaggaacagaaaaccaaacaccacatgttctcactcataagtgtgagctgaataatgagaacacatggacacaggaaggggaacaacacacactggggcctgtctggggtgggagtggagggagggaaagtatcaggaaaaatagctaatgcaggctgggcttaataccttaattgctgtcgataagtacagcaaaccaccatggcacacatttacctatgtaacaaacctgcgagtcctgcacatgtatcccggaacttaaaataaaaaagcaacatgtatcccatgaaaaaaaatatggttctattttatcttcctcctgcctacccctgctctcctctccctccagcttggcatacaacaggtgctcaataaaggcttgagaaattgataagaatggaattcaaccttatatttgttctttctctgaaaagaatcttggtattagcttgactaatccttttgctccatgcaattggctagtgccaccttcatatttttctgatatcattaagccccagctgcctcttccctggagctcagggatattgcaggaaaaggggtctgctctctccacttcttctctcctccaaggtttgttttgaaaaaccctgctgccagggcaggctcccgtgttacgctgctcacaaaagcacacatcttccctgccagcctttgctcagttattttattccctctctaacaagtacttgtggagccttactatgtcttcagcacagttctaggttatcaggataagattgtgaaccacacaccaggtcctttcatggagcttattttctagcctggaggagacacacattaaagacagactgcagcacacaggccgcatgcagcccactgcctgcttttgtaaataaagttttactgggacacaaccatgcagtccattcatttactcgttatctatggctgtgtccacactaccatggcagaggtgagtagttgtgatagagaatgcatggtctgtgaaataaaagtatttacacctggccctttgcaggaaaaatcttcccatgtctgcattaaacaaatgagtacgcaggaaaccaacatgcctgtgaacaatgctatgatgggtgatgagatagagggtaggtgtgcatgtgtgtgtgagtgtatatagtaaatgtgtgtgtgctggttttagaataagtggccaggagaggcctcactgagcagctgacatctcagaggggacttccacaccagaggcaagcccctctgggagcagagactgctcctgtctggtttgctcacgcatgtccccaggctagcatagggccgtaggctggacacctccagagcactgatgtgaagatgtggatgtgaggttgtgatgcagatgccctggaagactaaacacatttactcctcgcgtccactgtaaactacaacatgtgctgtgtgttcatcctctaattcgctgccctgcctgggaggtgcttgctttctttttcttgcagccgttctgaccaccctcatagcactgtgtgtgtgtgtgtgtgtgtgtgtgtgtgtgtgtgtgtgtgtgtgtgtgctgtgtgcatgtatgtgcacctgatgccctccccaaccattccatggcccaccttgccaccttgccatcttattataatatcccgatgtcctgaatggacactttccatccaccatgaatgcaatagaacctggaatgtaatggcttacgagaatcagcaacacaaagggagaaacagaagttcagttccctttgttctgatagaaacttactgtttgcatccaccaagaaacacaaccaaagaacagccatgaatatcatcccatgagagagcacatggctgtgtcagaccctgccctgagccccccttctcagtctgaccttggactctgctggaggtccctgctggacgtggacacagggccagggaatggtagggtcctcagttgcattgcatccttgtcgttgtacagatggggaaactgaggctaacaaagagaagaagtctctcctactgacccatggctaggaaacagcagggctagaagtgagtcccaggtaaactgaggctgggatactccagctgcacactcacacagctaccatgtaagctggtggttggggcctgggcctggcagtcaggccactccacctactcgctcatgcaagtcaccttccatctctgtcttctttggcactgtcctgagccttaaatgagctcacacaggtcaagttcttagccaagtataacacaaaatcaatgaacaatatgtcttagacatgattattgccacatctttcaccatagacggtaactgcttaggcacagactgtgacttggttgtctttgattcaacacaaaccagtgtcacctctggatcagagccctcccgcgtatgaactgctcttgctgtgtggtgggaaattatctcccactcatcttcaggtgagtccactttcaccttctgtgggatagactgcagacagtcggctacatttaaattgggccaaaagaaaggcagcagacacacatccccagtcaggctttgcttcttctgggctctgggttccccatctgtatgaggagagccccccagcttggtgatgccatgagtccctgggcggggcagtggggagggtggggtgccttacctggcccactgcagaaagaggcgatgatggccagaatgcccacgatactcaggtaggggacccagggggcgtggtcctgggagagaacagggagtggtcaggtgaggaggtgatggtgtgaccggaggacctgagttcccaccccagctcctcctccatccatctgtgtgaccttggacaggtcacttgatgtccccaagccccagcttcagcatctataacatgggaacaatgataacccttcggtcactccatctgcttattttatagccatgatgaaatcagatgaagcctgtgatgagtttgacatagtcctggcatacaggaagtggtaaataaatcaataactcacattgattgagggcttagttggcatcaggcaatatgagcaattttcacagctttatcacatttataaaagttcatcattctcagcaaactgacacaagaaccgaaaaccaaaccccacatgtctcactcataagtgggagttgaacaatgagaacacatggacacagggaggggaacatcacatgctggggcctgttttggggggtggggggctggaggagggatagcattaggagaaacacctaatgtagatgatgggttgatgggtgcagccaaccaccatggcacatgtatacctatgtaacaaacctgcacgttctgcacatgtatcccagaacttaaagtatatatatacatatatatatatatatgtatatatatgaatgtttcctcatatacattttaaaggcttctatattttgcttaaaagaagttatcttagttctgatattattacataaaggaccttatttgtacccctgccatcttgcaaggtgtgagatgcgttaattcatttcatggaatatgtctggagaagctgtcactcatccggggggtgggtggcttggtgctggttgggattgctcctgctctagcagactggacagctgagcattagaacacagtgtcaccagttctgaatctgtgggggtgccagggctgccccaggagaggccacctgacttgaagggaaggtaagagcctgcgttcatctctgtaggctgagccagagtcagcccagtgggaaaggaaaggaaagaggttccagtagggggttcagcatacacaagggcatagaatcctaagagggcaccatcggcgggggggtaagctgcaaacagtctggagtggagggcgaggggtacagagggcagacagaggaatggggaactccctccttccccttgttctatgtccaaatccattagctttaggggttgagaggagcttcatggactcttgtacactgtatggcttgcttctgtaccaagtcactcactcactcactaattcagctgattgatccgagctgcccctgggtgccaggcactgggatgggaggtggaaatgcagatatggttcatgccaggcccttgccctacacaactcactcactgtctatttggagagagacatgtgccaacagtgaaagtcaatggtatgtgataagtgatctcacagggttcccccttggggcttatgggaacacaggagagagcacctcacccagacttggaagcaaggggaggcttcctgcaggaagaggtgtccaggaatgtccaaggcctcctgagtccagagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggggtttgtgggcttcaggctttccttttaaacttcggacacaagtttcagaaagacaatggcctggaacatcgcctaactggcttcctgagaactttgaaggactgtaaagatgctggagcttgggacagcttgggcctggctgtcaggaaggaactgcatctgccagcacattgtccctgaaggcaatgcttccacctcctgccggtcagcgtgcttgccagccccacctcttcaaagggcacccatcagccaccaccatgctaacagtgccttcttctagaaacatttgggccactaagacatttgacaggtgatcaaaatgtgcacctatcaatttccagatgcatttttgaaaaatgcaaagattaatcaattgctgcaaccttgcttcacgcttcccatggcaccaagatgagttggaggtactgaggcagtgttcagttaatgcaagctgccctgagccatgcagggggcagaagcccaggatccggggatctaattgccaccttttggtggtgtaaccttgggaagcttatttatttatatttatccctcagtttccttatctccataaaacaaaaaaatactgatgttgtaaggatgaagtacatcgccacccctcctccttcatggacatccactgagtgcttgttccaagtgctttcagtgcattttctcatttcatcccacaacacccctggatgaagggacgactgtttcattttagagatgaggcccggagaggagctgacttgctaaagtttcattacaagtaaggaaaagccagggtccacacaggctgtctggctccagagccactgttcctaaaattgtgacaactagggaagtggctgatatgcagcacctggcactcatgctgggaggtgacagctggaaggagcaccttaaggttgtctagtgcaagctcttctattccatagatgggtgaactgaggctcagagatggaaagtgtcttgcccaagatcacacggctcatcagtgagagtgacaggaccagaagtcaggtctctcatctcccagtccaaggacccctcaccaaaccctcttcactgagaccctcagcagctccagagatgagatgtccccggggagagctttatcacaagtgttttctgtagaagtatgaacccacaaatcaaaggccccaaaacgatgaagccagaagtcagctccatgcttatctccctcaaatgtgacaagaacatcgtctcacctgcagggtcagcgtgatggtgagggtcccaaagaagaggcccatgagcccaaagccaccaatgaggaggggtctccgtcccaggtgctcaatgaccaaaccctagtccagggtaaaagagagagagagagctattattccatttctaaccacaacaggggaatgtggcactgggaaccggcaatggcatcatgattaaaaaccggctttgaccctgagacagttgggccaccttctttatggccacagccctgaagcaatgctctttatgagaaaggaaaaagcgagggagagaaagtcacaattcttgagcacctacagcattaataacgagcactctcctccgaatcttccttgctatggtggactcctccaacagggagtctgggagaaggaactggatggatatggtcaccacagcccttctcctccttcagaggcaacctgcatggaaggtgactcctctgtgtctccatgttgtgggtttcataggggtaggcatccacagcggggcacaggggtgggagtaggcagagaagcccatgtcgttttccagtctgcctgtgtctggggaagtcaatttcattgtgggatgtgatgtggggagtccctggggaagtccctaaagctgtgtcctcgaagccagcttccctcggcctaggactgtcactgacctccatctggctggcccctgtgccccttgtccacttggtcaggaaacagctcctcaactgccaatgactgaaagagtaattgtagccgaatgtcagagacaggaaaacctgggtttatattccggctttactattttccagatgcacgaactttggcatgtcacttcacttcccaaagccccagggcctttatctgtgacaagagaatcaaaatatccttccacaagagtgtctggagtggaagggtgtgttaaataagagactgcactcaacacacaggttaggtactcggattatgtgaggtatcctcctctcatgctccatatcacaaaaagagaacacggagggtcagagaggtgagataacagcagacatcacagagcaagtaggtgagagagggccagaaattgagcccagaatgaatcagaatccatggcttttctcaatgaggcaatcaggcgaggcttcctggaggaggcaggagcagacagagatgtggagagcttgtcaggcagagggattagtgggggaaaaggttttggggctggatggtccccatcacgacagtcatttggcttggacaaggggaagcagtgacgctgctgagggccatgaagccagagcacacatggctcctgcctgccagcttcaggtgacagtgcgaaggtcacagcactgagacgaacagttgcaatccttccccaaagcctcagggtttctccacaatggaacccagctgcagggaccccagtgccctctacctgttcctctttcctcataccctgctccttagagggaggcaggtgagaagccgtctaggcaatgggcgttctcccccaagcttagcatgggctgttgttctgctgggcagagccggcactgaggggtgagtgacagctgcctgtccgaagggcatagccctgtgggtcagctgagcaccccggccatgtagtgctgcctggggccatggacctctcagtcacctgggcatgaatgttgaggggaacggagggtgctggccccgaaagtcagaggcctgggaggaaaatgtgcctggctgatgaccacatgtctctaaaagcatccaagacttctggtcagaaatgcctttctcctgggtgcttagggaagaagggcagactcaagcctttaaacttggcctcctagaaacctggcccagtggaacagagcacaggtgacatccaggggcacaaaagcctgaagatgggccatctgagctgaattcctggctttgccacttagccttctttgcacccaggacaggttattcagcttttccaagtctcagtttccccacctggaaaatgagaatgataataccatttttgcagggtagctgtgagataaagcgaaagaactcacaatgcctgaaatagactcatgaacaaaagaggttgccaataaatggcaggaaatatattattcattttaactaaggagtgccctggggatctggtcccaactcttacccgtagctggctgtgtggccttgaacaagttaattaacccttccatgtcttaatttctcatcttttctgatgataatggagttagtctagataccaatagctaatgatcatttactgagcacctactatgtgccaagcactgtattaagcacttttcatgcagcaactcatttaatcctgacaataattttgagtaggttctattatttgctccattttacaggtaaaagaacagaggcacagagtctttggaaacttgtccagggtcacatggctggtaagtggcaaagctgggatcacctacaaaatcttttctgttgttgtgacattacattttcttgacattaaactagaaacagtcaatgccaccacttggtaacagcccagtgtctcacctggtccagctcccggacccgaacaagggcactgatcacttttctgcccccccaccccctcccccctccgcattcctggctctctgattctctttcttcacttgaaggctaggagccttcatctttgctttcccagagcctggaagaatacctgacaggtgtggcgtaagtgtttgctgagggagggaaggtctgtctttataacgcaggcagaatgattctcatttgcagggggagggcggggagggcagtgaggttcaagaatactgagggacagtaacttcacttggtgggaagtggggagggaagtcaggcccagtgagagtcaggagggaagcaatgaccaacagcttctgagaaagagagatagggggaggcagagagggacggagggagagaatgagggagggagggagggagtgagggagggagggagacacagagaaacctgcatttaaagcatcccttcctcttaggccctcatgagctgggtttcatcaaagaggagacactgatggggctgctgtgccaggtccagtgcaacatgggcaagggagctgggtcctagtgccaggagggacccccgcaaaggtaataggagaaaaggcccagagatatcaggggcttagagagattatgaaattatgggcccagagagattatgcttatctctgtgtaactcatactaatttcagtgtaacaatgcaacacatgttaatctcagcgcaacacatgttaatcttggcgtagcactctcagtgatctgggcccaggatcagaggccaagagtgattatgggatttaccaaaagtcacccagggctaactattcagagagaaggaagtgggatagatgctgttttacaccaaggggcagttgcaaacgtccacacccttggactcagtcactcaccttctgggcattgatcctaaggaaatagatgtttggtcaaagatgcatggacaacgatctttgttggtgtgttatttatactactggggaaatagaaataatctagaaatccaccaacaattagttaaataaatgctggaatatctagatggtaaatatgtagaaattaacatagtttaaagaattgtaaaatggtacagaaaaattctcagggtacaatcttaggcgaaaagagtaggacataaatctgtatatactaaaacatgtagttatataatatcaattacaattatgttaagctaatacaccctggaaaaatatatgcagaaatagtttataatggctaactctggttgggggaatatgtgattattattttatttgtctgtcagttttcctgattttctccggagagttttgacttaaaaacaccaaaaagtagatttagttgaagtgttggatgcaaatctctgtcccctgtattatgtctttattctttccaaatcaccaaatatttccaatacccatactggcaatttttcataactgtgtaaaatatggttttggtacaatctaaagatgtcacagcttttcttgtggctaacaggacagagccaaaagttaagctgttgctgaaaatgaaggttgttcataactggaatatgcaggaactctgtctcctaagcttcttaggggagttggattagagtatccagtgacctggtgctgaaatgacaacagaatgtgccatggaagagcatcacagttgctgggagatattattacactgcaatcagcatgtgttacattgtcatagggagatcagcacatgttacattgttataatgagattaatatgtgttatattgttacactaagcttatcatgtgttacattgttttacggaaattaacatatatgtttactgatttcagtattttgaagtttttaaaaaagagtttcaagtgcaccacccacaatttcagagtcagaaagtgtgcttacaaaagtcagttgagaaccattatcttacaccatgatgctgacgttcaaatactttggaaagggtggggtgagggacatgtggctttttgtttcgtttccctaaagtctcttgatgaaccagtaacttgagccaatgaaaggctgaacacattctccctgattcagaaatgatctttaaagatggtctaggaagacaccagggaaacagctttgaaagagaaagaagggataaaaacaaccctcccatctgacaatcagtctcccggctctgttcttcttccctccctcctttaagtccagttaaagtgcagcctgttggaagggattagagcgaacgtggtatttccacttgacattaaaatcatgagtgaagacattaactcagacgaacagcagactgaaggctactgatgtcagctagggatgactgtcaaaatcctaatgctcccaggaaacccctctggggactctggagccatggggtcacccatccactcagcagccattcacccagcacccagtgcccttccccacagggctgggacctctggtgaaataataatgggaaccttttgttctggttaggattttaagaagcagctttataaaggtgtagttttcattcagtctaatgtacccatttgaattgcacagtcttgtatgttttgacaaatgtatataccttataaccacaactacaattaggatattgaacatttccatcacttcccagaattatcttgtgtctcttcccccaactccaggcaacctccgatctgctttccagcacaaggattcgatttatcatttcatattgcttattgcagtgtttttgagattcatccttcttgtagtacatatcaacagttcttttgtattgctgatcagtattccattgcatggatataccaaaatttgtttctccattcacctgttgacccaatagctgtttccaattttcagctctgagaaataaaaccattatgattattgagtcttcatgtagacttgtgcattgatttctcttgggtaaatatgtataagtggaatgactgagttggatgggtaaaacctttataagaaactgctaaaatgttatctgaaggggttgtgccattttatgttcccaccagcagtggatgagccttcctgttactccacatccttggcaacacgtggtattatatcaaccatttaaatttttgtcaccattttggtgaacaatggtatctcactgttggttttagttttaatttccctggtgacagtaacaatgttgaagatcttttcatgtgatttttgatgttttggaactcttctttggtaaagcatgtgttcatatattttgctcattttcaagtgggcagttggtcttatttttgagttttaagagttctttatgtattctgaattcacgtcccctctcaaatgtgttttataggtatgttctccatgtctgtgacttacctttttatctccttaacaataccttttaaatagtcacagtttttaattttgatgaaatccaatgtatcatttgaaaaatggtttgtgattctgtatctttcctatcctaatgttgcaaaactttctcctttgcttctagaagttttagagtttagcttttatgtctagatacgtggtccattttgagttaattttttgtatggtataataagggttgccattcacatttttccatgtggatatctactttttatgacactacttgttgaaaagactatcctttcctcattgaattacttcagcaactttttgttttctggattccattctgttccattgatctgtggggctgcccttatgccaatctcatgctgtctttattcccatgtttgaacattgttacaatccttgctatgtaccaggaatggttccggctgctttatatatattaataacttaactctgattacattttcttggggtaggtgctgttatcatccactattatatccagaacttgaggctcagagaggtttagcaacctggctaaggttgcacagtgagtcagaattcaagtctaggcactccggctccagagtcttgctcttaacctttgtgttctacttcctctccccagtgtttctgaggcaaatacacattcacatttatcaaaagaatatgcacatgctcccaaagtttttctcccttcatttgtgtgagctgcctgaggtcactgagagcctccaacagcactggcactggggcacagagaagacagagccaggagtctctgcccttggggagctttatgggctgaattgcattctctcaaaaaaggaaatattggaatcctaatctcctattccctagaatgtgaccttgtttgggaatggggtctttatttttaggtgattcagttaaaaaaatgtgaccttgtttgggaatagggtctttatttttaggtgattcagttaaaatgacatcatttggatgggcctcaatccatgatgactggtgtccttgagccaatggaaaagggaaagtgtggacacggagacagacacgcacacaggcctgtaatcccagcactttgggaggccaaaatgggtggattacttgaggtcaggagttcgagaccagcctggccaacatgatgaaaccctgtctctactaaaaaaaatacaaaaagtagccaggtgtggtggtgcatgcctgtaatcgcagctacacgggaggctgaggcaggagggaggttgaatcgctggaactgggatgcaaaggttgcagtgagctgagattgtgctactgcattccagcctgggtgacagagtgagacattccacctcagaaaaaccaaaaacaaaaaaagacatacacagacagaatgtcatctgaagatgaggcaggggttgggatgatgcttctgccaactaagaaacacccaagatcacctgtaagttcctggaagctgggagagaggcacgggacattctccctcacagccctcaggagaagtgagcactgctgatgctttgctctcaggcttctggccttgagaactgtgatacaataaattcctgttgtttaagccacgtagtttgtggcacattgttttggcagcctgggcaaaccaacacaaggagctaacacctgatggagggcagggcttgtaatgttgcctgctaaatgattgaatgtatgtaaaaaaaagaaggaaggtagtctccaaatatgtacaactattatatgacaataaacaacattttaaaaaggaagagctggagggcaagaaaatatcgcctaaaatttaatttatttcaaatttatctcaattaaagcgtccaaatttgatgtaatgtgctttcatattatttcacatacattactttatatacactttatttattgctcattgtctatattgtattcaatgtgtatatctctctatataaactgcatgcggtactccgtgcatggcaggagttcctgactttctcagggactacagcgtcctacatgagttcttccctgtgccagggtgagccttttggtcgtagaagatgccccattctctgtgtccaactccaggccggggcctttttaaattcttctgatttacataatccccatccttgcctggcttgatgcttctgggtctgtgggccgtgtggactgattgtgcgcaggggccctagaagcctaccaggaggaagccctgttggttgggctctgcctccctcaggacgtcctgtctgactgctccctgcagggatcccagccaaaggcaagagctccctctttagtcagctggtgtgatttcctcaacaggctttactagagccgtactccgttgagcaaccattaatggtattgaatgcatgacaactactatggccatttctttaaacatgatgcatgacacacactctctctctccctccctccccctctctctctctctttctctctttcaaatttacattttaaagcaactctatgaggtttcccctaataactcagccaaagcggtgcagacaactgagactctttcagagagaaatgtaaatgctggggcaagatgtggcccagatgagggccaccccgcaggcatcccaaacagctgtttcctaatcctgacatgttggaatggaggagtacctgaggaacccttggcacatgagcaattggtgactttctagtcagaagttggattattgtcaaagttttagctgcaaaaggatgggagaaaggagcagagaatggtgtgattatcactgacgcagctccctctgcagagaacagaaggccaaggtacattacatgaaaagcaatttcacattccagtattacttttagctgctggtaatcctgttttaaacatgcaaaggctaatctttactttcacagatctctctaaaaagaagccaagaccttggaaagctgtggttattgcaagttagtgaaattttaaaatttatgttcagaggacagagtgccagaaacaattttctgcttgggacaggctctctctaagttaaaaacggaatataattcaatgaaacaaacttttttgggaatttctgcttaaaagatgaatgtgcataaaaggtatcggtgtatctgtttgggccaaaggtgtgagaaatgagagttgtgttttaaataatgatcatcccagggtggcccatgatctctaagtataacaaattaaaatgtcttgagatatttcagccaaagtgcaaaacagacatgggttttccttccatcccatgccaactgggatggaaggaaaggctggcagcagacaggcttttccaagttctccagtcctgtggacgtctcctccacttgggtcactttacaagcttggcttgaggccgtagcttctgcagtttctaagtgaagcactccccctcatgctcttactcttctcaaaaaaggcaaaatgtggttctcaacaggtttgtgaggatacattcatattgttcttggaaatttgggcaagtagaaaaaaaaatagctcttcaaggagcagagaaagagacactggatgtccagatgacttaggagtcagggcttccatagcaggagcatcgagttggcagagggcagtgggcagtgggaacagccgccacttagaactgacacaaggggatggtaaatgctgtctccaccctgcatcccatgagccacatccgcactttcctttggtgagtgaagctggtggggccggacacaggggagccaaaggatgttatcagagggatggggagtaaatcaggaaaatttggtgggaagtaaagactcaggagcacatcccaagagtcagagggtgagctgcaggaacggacttgtgggtatgtccttggccaaactcaaaaatagagctacttacttaaaagatattattcagagcttggggtgggtgggagtggaaactgcaggggaatgtgcttccagggcaaaaccccaccttttctgcttggggatgctggggcactgactctgtttcttcccttcctcatccccacccagtcctcaccccatgaggataacctgtcataaccagaagtattagttcattctcatgctgctataaagaactgccgaagactgggtagtttacaaaggaaagaggtttaattgacaaagttccacagggcgggggaggcctcaggaaacttacaatcatggtggaaggggaagcaaactcatccttcttcatgtggtggcaggaaggagaatgagtgtccagtgaagggggaagtcccttataaaaccatcagctctcatgagaactcactcactatcatgagaacagcatgagggtaactgctcctatgattcaattacctcccaccggtccctcccatgacacatggggattgtgggaactataattcaaggtgagatttgggtggggacacagagccaaaccatatcaacgagagtccacatttctctgcctgcttcctgctcaggcaatggtaacactaatgcttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgttaaataaactggggacttgatctagtattttagtggaggaagggtgtagtttcttctagtctgtgacctatagaaatgccatagaatcattatttatcaatgaaaaaggaatgtctgtcaagggaaattaattgaactcagtcctttcgaggccagttctagagcacatgtcagtgtgatgattcacagggaaaaccggcctctctccaagccttgtgacaacgctgtttctacccttgtcaccctctgccattatctattttgtctacagcagtcagagggatttaaagcatgacctggcactctccttttaacacccctgtccactaaaagccttatagacagcaaagaaaacaatcaacagagtgaagagaaaacctacaaaatgggagaaaagatttgcaaaccatatttgaatcccctcaagccccatgcccccccaccagccccttggcccctcaagcggcagccacatccttgcccctgccttgggctgctgcagacatccctgtcacctctcagattcttgctgtctgtcctagagggagacccattggctcaaatcaacaagctccctgccctctgacctctaggcggcttcagcagaaatcagaaatcagaggtcagaaatcagaaggcaaaagaaagagaatgaggccaggggttggtttcttggttcactttctacagagacattttgcctggctttgtccctctatcaaaggttgcagctcctgataggtggcgtacccaccctacatgccctcggctgccctgaattaatctgccttcgagctgctcaggttcactgtgtccctctttcccaaaggtttttctttcagcagcttcttttgcctgacatgctcttcccagacagctgggctcacctggagcctgaccacaatatttaaaatggcaactgcccccgtctctccattcccctttctctgctctactgttttctcataacatccttcaccttctaaaacactgtgtggggtactcccttgttacactgtctgtgaccccatgaggagctctccttctccacagcagagacctttgtctgttttgtccactggcacagagcaggggcccaagtgagcacttgctgagtgctggaggaagaagcatcctggccttgggctcgtcttctagtctttgagaggtagcagggcagcttcggcattttccatgtctgcttctcttcaggaatattaataacaagagtaactgcgtgagtttcccagggctgccgtgataaggtcccacagacagagcggcttcagcaatagaaacgtgttgtctcacagttctggaggctggaagtccaagatcaaagtgtctgcagggccctgcctctggaggcgccagggaagggtctgttgcagggccctctcctggcttctagtgtgttttggctttcagcagcacaattctaatttttagagggcgttctgcctgtgtgtatgcctgcatctaaattttcccttttcataaggacagtcgtattggattaggggcccaccctattccagtataaccgtatcttaccttaactaattacaactgcaatgatcctatttccaattcaagtcacattccgaggtactagggacttcaacacatgcattttgaggaggtgcaattcaacccataacaatagtgaacatttattgagtatgttctctatgccaagcactgtgaattacagtatgattcccatgacaatacctgctgaggcttagatctgttattattgccactttcactaagagaaaaatgggtatcagagaggttaagtgactagctcaaggtcacccagctagcagctgcggggccagtatgaaacagagcccagatgatctatcaccctgctttctcccttttaccacgttctgctctcacacgggctggatccagtgtcctgagttccagcagtaaactctgaggcctttgattctgaaattgtcgaatttattgggaagcaatggagactacaggcaacagaaaccataaggattttttttttttttactacaagtcaagagcatattccattcttgctaattatgaaaatgtactgcagtgaatcagaatgacttcctgtgaattctgacccctgatttgtaaaagcacagagtctgtgcttctcaagagtgagccctcaccccacaaagctcctgccccacatggcctgaatgacgctcactggaagttcactcatcagagagttaacactgtgccaggcaaatcaatttggaaaaccagctgtttctgaaagatggcgattatttacagttccccaagctgatgactgacgccctgagccaaaattaattgcagatcaaatgagcaaagatgtctttcccctctcaactttattagcctcctgagccattttaatagactgtcaaaatctcataagaggaatgaaaaaaattggaaagtctttttggataagcaatcacttcaaagggctggatgaaatatatagacatatatttgtgtgtttattacatatgtaactgtatatatataaatatatttattgccttcttttcaaatatatttcaagatatataatatattttgtatattatataaatatataaaatatattttatatattataaattttatatatttatatattttatatcaataaatatataaaatatatctacatattttatttccttgttttcaaatacataatatataaacattataatatattatgcatattatatatataacctatataaatatgatatttttatatatacataactttggaaagtgcaaggaacttaccttatattgatgctctgtgaggaacaggggagtggctttcacacactttggattttgtttccataattctgtcagatgctgtattagtttcctattgctgctgtagcgagttaccacagactcagtggcttaaaacaacccaggtggattatcttatagttttggaaatcagaagtctagaatagatcttgcagtgcaaacacgatggtgtctgcagggctggttccttctggaggctccagggcagaatcttgcctgctgcagcttctagagaacatctgcattcctgggcgtgtgaccccttcctcaccttcaaagctggcaatggcgtcactcctgcctctgcttccaccatcacatctccttctctgactctgaccctcctgcctccccctttcacttacaaggaccctgtgataatattgggctcacctgggtaatccagggttagctccctatctcaagattagtcccacctgcaacattcctttgtgccatgtaaggtaatatattcccagcttctgggaatcatggtgtggacatcttggggagccattgttttgcctaccacaggtgggaatggttatgtccattttacagatgagcaaataaattcagatgtgttgggcaatgttcccaagaccacttagctggtaaatgggtgatcaggatttgaattcagagtagcctcatcctaaagccaaagctgtttctccccagaacatttttctattccacactctcaacctcatgctgaatttagtttcatgcctttccaggaattggggtcaatgctaccattttaaggactgtttccaatggactattctgcatccatccttgcatctccagctctttgagaagatgaaagggggacagactacccaatgcacttcacttcacctaacttctgctggcccttcagctctcaggttcctggtccctgtctccaggaatccctcccagaaccccttatttgagagggaagctcgtctcagtgttgcatgtggtaattgtttccaggtttgcttttctctctagatcacggcaacgtcacctgtgacagctggcacagtatgagtgcaccttaggtgtctgtggaatggatgaatgcatgcctgcatgaaagaatccaccacccaagctctgaatcatcacttcctgctcagaggaacctcccacacagagattcctgcacctctagaacagcaaaacatcatttatccttgggtcatagtcaacctcctccattggactgtgagctcctacaggcaggcaccatggcaaaggccctctgtaagcccagcacagggccaacagcctgaccatgggaggagctggcaagagcttgctaaatggcggggtaccaactggccatggtccagatgactgagatccactgggtccaaacttaaaggcagtggcaggagtgctctccagaggctgagactctgagttctgattttagaaaggactcttccttcccttccaggactgtgaagtcatttaccctcctttctggggtttccaaggaatactttgcccaaaattgtcagcttttaaggaagatgatctgcctgccagagcatcgggatgagaaggagtggcttctggagtctggaatgaataagaatggcttcccgtgaagtcttcttgcaccaagggaagaagtgtagccacttcctcagtgtgcccctctttcaaacaatggcagtcattggactttcaggcatgatgtgagcattcatgaggtcccatgtagaacactttggggtgtcggtggcagggacagtaggggccccatgatgttctctttccccactctcttgggttctgagccagctgactgtgtgacccagagtaagtcactccttttggtcttagtttcctcaactgtcaaaagatagcaagaccccctgtaaaatcctgctctccacaaggatgtccatcgtagccttatgtaaaatcacacattatggaaatctacctaaataggacaagaatagttaccacttactgggtgtataccatttgccagccactgctggaatcacttaatgtatattcattggtacaatcctcagcccatccctatgaagcagggatgatggcttttagaagtggggaaactgagtcacagagatgctgaataacttacttgggggtcacgcggctaataaaaagacacagagctgggactggaacccagaaagcatggcactgccatcaggttccgagcagagacattcaacaacctcacccgcagacaatggttaaggaaattatcatacagaaaattactggagaaggataaatcgttcagcactagtgttaattcagggaaggtgatgatctacatgattttctgcatatatgatacacttcaacaaaaaaataataaataagaaaatggagagtcattctgacataagattatgtgaacaaaagcagatcagagctcgtatttagaataggattactgtgctactatgtaagaaatatacatctatgcatagaaagacaagggaagaatttgccaaacttccttgggtagtatgattgtaggtaatttcttctttgttcctctctatttttccgaattttacaaatttgccctaatgagctggtattgatttcttcacaacaccaataaaatactttacaaaaaacaaaaaacatctcccgtacttcccccataagtttcatctcagactgtgtttttccattgctcaaagtaaaaataaataaacaaaactgggtgcagtctataacttgagaataacaagaatgaatcttgtgaaacttccagaatgtgaaacgttgaaatgttttcttctaataaaaagaccacaaagtggaaagggaaagagacaaaacatcattcctctacattttttatggtatctattttttaaaagcatcttgttagaatgacccattaagtgcaaggtacaaaatgaaatgttctgtcaacaagaagtcagaaagacaattgcaagcctctgcctgtttgcatgggcatcaatcttgtcagtgcaaatcagtgagcaagagtgaaaataaatgaactactccatcaaggtcagagaatataactctctaattttagccctctctttccatttggaagggagcctaactgtgtgctgtgtgcccaaaatgtgaggcacagacatagctacaaaaaagaagagacacaagcatttcataaagaggacaactgaagctcagagatgttgagtgcactgctcagtgctacacagccaagaagtgccggagccaggattcaaatccagtttgatctgattccaagatctggaaatttctactaggttctgaagccacccaactttcccctccaccagatgtttgttttgcatattggaggttgagaaacagtgaggagctctatgccttcttttgaacatattggcttattattaaggtcttcctctctattatactggtcaactgaatgtcctttctcctttgccttgcaaactcccacatgtctggggtaatgagatgactgctaatggttttgaaacattttaaatgtcatggtaagagattggagattcaagccaattctctgatccgaactcctggggacaatatggccctgtttcacagggcattcatatttcatcatttgtgactaggtgagaattcaaaggatggagttatttattaaaaggaagatgacagggaagcaaaatctaggaaggaaatattctctagatgggtaaaatgtcagtgaagaatattctctagatgggtaaaatgtcagtgaagagctgcatgatgacctcctaaaatccagccccctttggcatgataaaggacatgctcctctaaagagatgcctgtttgttgccttaggttcccacattgcagtgttgcctgccccggaggtgtcaggaactgggtgagaattgtcgctcttcagtacccactttgaggttttgggtcaatagcccagacacaaatgatgtctgggttctccccatcccagctatttctttaaaaccaagagtttgctgaatgataggaaaccacattgtcctaattgatgaattctgatggggaaagcctgtgccttaaaggaccttatgaacattcccactgtgctgtgtaaccccctgtggcattctcaggagtaaccctcagttgacttacagagaagacggcagccaaagtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagatagaaacagtaatgttggtggggcttccaggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccatcgtaactttatgagaaccagaaaaggtccccactacacaaaacgctttactgtcatccactgaaaaattgccatagtaaatccacaatgcatacaaggtgaaagatgttccccagagttgggtaatgcacaacctgtttaactatacatagagcccctgccttgggataaaagccacttgtttagatgctggaccaggaagttagaaagagttagcctgtgcccttactgactacactggttctgtaatttattatccaaacatgaggacttttgagagtgttgataattatgctaggatgacacacttacattgagtgtgtcctgggaaaaccaggatgtgtggtcttggagttgctataccagccctcgcaacttatttcatgtgagactgaaaaccttccatcttgttgaggtctctgttggggtacctgccacatgaggttagacctaaatcctaattgatgcccatggcatcagacaagaactgattaggagtttggagacctggctccatcttgaactagctgtgtgacctcaggcaattcaccctgccatgaggagattcctactcctccccagtcaaatgaacatgaccatgcttattttgcctgtcccatgaggtgtcaggaactgggtgagaattgtcactcttcagtattcactttgaggattttagcctggacacaaatgatgtctgggttctccccatcccagccatttctttaaaaccaagagtttgctgaatgatagaaaaccacattgtcctaactgatgaattctgatggggacaccccctgcattaaaggaccttatgaacatttatgaacagtttgatacttattcagcagaagtgttagagcacattgctcataacctgtcaggtccaacgttagctggccacactctcgcattttgctctttgtttctggatgaagctcttgtttctatagatctgttttattgccagatgtttttagcaaaaattattcatgcattggggggaagatataggacctacttatatctacagatggttaaattttgtgaagaaagtaaacctccataaagttatgggcataccaagagatgccagtgaaaactacgacacccatttcttcgagcttgcaggcatggatacatccatctattggcaaaaacaggttttaatattcgtgtaaaacaagaaccttcatgttctgcacctgtttctcacttgagtgaacgttagactccatcgttagcctgaacctttgctgtcacatccatggtgtacagaggtagtgcctaataaatccactaattcctattgttctcagggctgtgacagaagctgacattataacattatcctgaaaactctatgtccattgaatatgtttatacaattgcttcccctttagaaggtaactatgatccccagtgcaccgtcagggttggattccagaagtgtaacagcctttcttaatcatcagccaaattcactgattttcaatggccaacgttctctagggaccctcttaatgccctcaggctgccaggctgtcacccatgtgaaggtgtctgacatttgtgttattcacagccgtggttctgatccccatggcctgaccagctcatggtcctgaggctcccagccctaggtcccacttaatgtgaatcctcttatgatgtggccagcacctccttctggctcctctcacccctcacaaccccgtcttccctggtttcaattctccccatagagacactgctatagatgtcccttagtaggttagtgaagagagtcattgtacataaaattctaagttcagtgagggacagttataacttttgcagggaaattgatgaagctggaaaccatcattctcagcaaactaacataagaacagaaaaccaaacaccacatgttctcactcataagtggaagttgaacaatgagaatacatggaaacagagaggggaacatcatacaccagggcctgttggggtgtgggggggctagaggagggatggcattaggagaaatatccaatgcagatgacaggttgatgggtgcagcaaaccatcatggcacgtgtatacctatgtaacaaacctgcacattctccacaggtatcccagaacttaaagtataataataataataataaagcaataaaagccatatttagtcttatattcattcatgcaccaaaaggcagaaatcagtccacagatcctctcccgctgcccaggggctacaggggtcctgccgggctggccctgtctgccccggggcagacctgtacatcacacacactgccagtcttaatctgtttgtgacacgaagccactgccctccccctacatcagctgatagagtgggaaggtgactgccttcagctttacctctgctcacactgaagcttatttgattggacagtttgagttcactgtaaaataagaaagcactcaggaaacttaagagtgcatcctgccccggagccccgccagcccccacggtgtgtgctttgtgttgaccttgttcaccacacaactctgttctcgcaggttgcccctagcctccccgtgcagcgtggcaggagcagcagttctggaggcatagagtggggattctagccccagcactgtctctcatgacctgcgtgaccgcaggcaagcgattttgcatctcggaatctctgttctccaaagaaaggtaataatacttcgtctttcagggttcttgtaaaaattttaatgatgataaaagaaatcatccaggacagcacctgttataattggcatataacaaattgtaggtatcattctagaaggttctgtctctccatggagatgtgattgcttcttggttaagaagagcatctggaaccaacccaaatgtccaacaatgatagactggatgaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccgcatattctcactcataggtgggaattgaacaataagaacacatggacacaggaaggggaatatcacacaccagtgactgttctggggtggggggagcggggagggagagcattaggagatatacctaatgttaaatgacaagttaatgggtgcagcacaccaacatggcacatgtatacatatgtaacaaacctgcacgttgtgcacatgtaccctaaaacttaaagtataataataataaaaaaaaaagaaaagaagagcatctgacagtggcacatatgccatgctaggaatgcacctctgggtctcttttcagcctccttcttgtgggatggggctttgaagaactgtgcagctggcaggtgtgggggtaagggcagcaggaaagaatttgggtcttctcaagtccctgcccttaatgccctgaagctctcattcttaactcacgtcatagtgttttagagacaaagtgtaacatacataatcatttttgccccctccacagttgggcatgcctaaggatgcccaacatgtctaagaaagcagcatgtctaaggatcagtcaagggtccataagagtaaacatcccatttacttttgcctagaacaaggtgatactgacaaagagtatgggtttaatttatgctttctggatgtggtgagcagaacaacagccccccgctctcaaaatgttcacatgctaatcctgggaaccccagaacatcttactttacatggccaaagggactttgcagatatgttaagttcagaatcttgacatggggaagttatcctggattatctgggtgagctgtaaatgtaatcaccagggtccttaaagagggagtcaggaggatcagattcagagagaagacgtaaggatggaagcagaggtcagagaggaagaaatatttgaaaatgccatgctgctgacttgcagatgcagaaaggggccacaagccgagagatgcaggtgccatctagaagttgggaatgtcaaggaagtggatgatccctctggagtctccagaaggaatgtggccttgccaacaccttgattttaggacttctggcctccagaattgtaagataataaattggtgtggttttaagccaccatgtgggtggggctccttcaacaaaataatagctaagctattgcagtaatttgctacagaagcaatagaaaactaatatatactggataaagatataattaatatattttatgcatttcctgtgtgtttgtgtgtgtgtgtgtgtgtgtgtgtgtgagagagagagagagagagagagagacagagagagagagaaacagatagagagagataaagagagaaacagagagagttgtaaacacagaggtggccgccacagacaaatggtgatgtataggatctatcttgaagtacagaagacagagaagaccttgcccatttattaaacactgtgttccaggaactgtgccgatgcctcacctactgtttccagggacctcctttcccttctatttcctgtttccatttggggagcatccactagggaacatacctccctctcaacccaagggacagggaggtagggagtgccctcttgcatcccctgggctctttctgtatctgcctcctgcaggaagctggagatgtgtctgctgcctccacccaaggaggggcttgccctgtagaggggtctggggttgctccttctgcctgtggctgggtctagcatcttaaagctagaggtgctgaactaactgccacttatgaagccatgctgtctaatccagctccactcaaaatagagctaacattttcatccccatctggttcttgtgcctctctctgtctccccctctctaaccttttctgaatttcagagaagaagggggcttatctattgtaaatccccaaacctatcccctacatgacgtaactgcattcccagcacagcccagtgagggagctatcactgctccatttaacagatgtgaaactgaggctcagccaggtaagggtgacccagctatgagtggcagagctgagatcgagccctgatcatcccaaacatttctactgtcctctgctacctctgggtgagaaggaatctgttttccttccagagatgctaggggagggtgctaagtcctatggagcagggcaagtggaattacccgagaggtgagaggaaatgggagcaccagggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacaggacctgtgggtcactcactggccttgaagggttagctgggcttgaagctctggtccctggtggttgaatctccaaggcagggcaattgaccatctaacgtcccctctctgtgagctcctattcttgggagggacgggagtctgtgggctggacagaagggatttgaccccagcaattgctatggtggtgagaacgtgaatgcagatttcaaccaccccggccttgctttatatccttagagcacatgtgagcatgaaactggacagcatatctagatgcccaacagccggtccatgctcagtaaaaggctgcttccttctctgacctccactgtctttctttataaaaatccagaagcatacaaagtaaggactcaaattttaagagtggccagaaaatgcttgcttttaaaagcttttctaagagtgttggatcacccagtcttgcttctcatcttacggataaaaatctaacctcacactgacctagccattagcccaatgaatgataccacctttctggcctggtcttctttgaactctgacatgagtgattgaggctcagaggggtgaagtgtctcacccaggactacacagctgggaagtcagaggatgtgggctggaaccatagcctccctggtggtctcagtgtggggctccttcaacaaaataatagctaagattatggagcaccacctatgtgaatgaccccatgctgaacttatttatttgagacggagtttcgctcttgttgcccaggctggagtgcaatggtgcgatctcagctcattgcaacctctgcctcctgggttcaagtgattctcctgcctcagcctcctgagtatctgggattacaggcatgtgccaccacgtccagctaattttctatttttagtagagacttgtttctccatgttggtcaggctgatcttgaactcccgacctcaagtgatctgcccaccccaggctcccaaagtgctgggattacaggtgtgagccaccatgcccagctgctgaactttaaatgcatcctttcatctatcttcaccaccactctacagctggggaaactgaggcacggaggagtcatgacaacttgtccaagatcccataactcaaaagttcaatgttgcaagctgcatgcaggcagatgaccccaagcctggcactcttgaccacagttcagggtggccatatggagggtctcttctcagctttctccctgttcatcaggacatagcaaactgctgcagtgagatggtctccacttttatgattacagagcattttagattcttccaacttgatctaggaagtgatttcaggagaatcttttcaaaaccaaagttattaataactgcttctgaaattataatttgagactttgtacaaaacttgatttgggctccagaactcctaatgatggttcaacaaatcagatggaccttcatgtggttccaggccaaaagagggggaaagtaccacagttttctgtaaacacatctaaagttttcatgtctccttccccttgttcctcccagtcacctcccttccctcccttctactcaactgtttagagaaagcgtaagaaatctgggactctcttaggcactaaggtgacagcagacaacacaggtcctcgtctaccctagaagacctcttagtctagcaaggaagggaggagtacacaacgatttcccaactaagtggttagaggaacacaccaggaaccctgtaatgcatgggtatcccaccaagtgcaaagacccaggcagcagtccaccgccggtgagcacccagaaccaatgtcaccaggcccatatggctcattcacagctggcactctgatcctctttgctcttcttttacatctatttctaacacacttgggtgtcttgtttcccaaccaagactgcatatcaggaagcagcagattttgaaactgcatggcattgagagaggagaaaacaatgctagaaacagtcgtgctgatgacagcaaggttgggaggagattcatgcaagctgagcagctgccacctgtgagatattttacataattccacagattcctcacagcagttgtgcaaactgagtattatcatccccatttttcaggatgggagactgaagcccagggaagtgactatgattggcttctgtgtttaagaaagaaggaatcccaaggaaggaagggtcatcccaagtagataagagaaccaccatgaccctgggcattctggaagataagggaaggttcaagaaaatgaaggcttccccacactgggcttgacaattggtattgatccaattttcagcccaagaactccctatctcctgccctcacctccttttctcccccagacactcaggtgcccaccatgtggcatgggctgctctggtgctggaggcacagggttgataagatgcagcctccatctcccaggatggagacccactaatagctctctccaggtgaggggagcacagtggaggggcaggaactgctgtggccaccccagcaatggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttatcccaacttttgaataatttcttttttcctttttttttttttttttttttttttgtgatggagtcttgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtgctgggattacaggcacaagacactgcacccagcaaaattttgagtgacttctaaagtacgtgaaaaacattcatcagctccttagcataaatatactgagccatctgtgatgtttgcttgatacagaggttctcagccaggggcaattttgctcccatgggatgtttggcagtgtctggagccatttttggttgtcacagctggtggggcagatggtgctactggtacctaatgggaagaggccagggaggctgctgaatagcctaggcacacagcacagcccccatgacaatgaattttccagctcaaaatgtacacagatatgaggctgagaaatgcaagtttggtacaaagtgtctgggtgggctgtccagggagtgcacccaacaccagcaggtgtgactttgtctgtgcaggcaccacccctgggaccttgggcaatgcctgaccctctgtgagtcacacgtccttcatctagaaaatggggacaataccacttaccctgtggggctgtttggggcttgaataaaatgacaaacacagagatgcctggcagtatttacggatgtctccagtgacatgtcatgtcccccaaataatgtctgggataatgaagaagacaaagcaagtcttccaaggcagctgaagttttggatcccaggggtggtgcctgcacagaaaaagtcacacctgctagtgctggtagctctctttgtcccgtgaatttggatgacaaggcagcaggtacaggggagagctggaccacagtgtggctgtgatgctggcatttgccactaaacagcatgggtctctctgtatgtaacacggaagaagacttgtccccatggctgcctagggatggcctggggacacagcctgagtgacatgcatgggggtgctctgagggggaccttggggccagatagctagggctcaaatccttttactattcctcactgtttgaccttggaaaagtttctttatgtctttaggcctaacagtgcggcctaactcacagggcagccatggggacagctcctggcccactctgagtgctacatgcatgtgcacttgatgaggtttgcagcccagtaggtggaggccaagtgacggggagcagctggcctgggtttctcactgcaggtttgtgtcccactgagatgggaagccaggcctctgactcttggtccagagctctgctccaggtcaggtaaagcacgctcagctggaaatattatcccgacttaaagattgaagatcatcaacatgggagggcagaacactctgaggatggggcctcatgactgctggctttgggagcagctgagattttttttcaacaggtgcttagtcagtgcggcttgcaggtacaccatagaggaatttatgaagttatacgggggatgcaaatggaaaaatgatgtccctgtggagaattgaattctgtttagaactgatggttctcagtgtaaatgcctcattcactacaggttccatattcggtctttaaggcttcaggtgttagcttgaagaaacaattcacttcccctctctactctctgagaacaagcagcgcctccttcagactgtctggcaaaacctcggtctcgtcaacaggaagagacaacaggactctcccaggatcactcagttaatgtaggtacagccactgacccaggcgcctgctcaatctgctgactttaaccagaccaaggagaaaggtaaaagcaagaagcaaggtgatctcatttcatcccagtgtttccgaaaatagaaccaacagttgttgaaaggaggtggaacaacactgtggttgtagatttctatgctgctgtttttccttctctggacaggaatgactccccttcacatcaccttccctagacacccccaaacaccctccctgcccgccttggggggtgctggtctcacgcttatttagtataaatgcaagctgtcttactggggccctttggaagggtgctggcgggtgccccttctccctctctctgggttcagtcagtctcctcccaagtgacatgagtgacctcagaggcagtttggatgctttatgcaagaatctcctctacgctcccctgccaagtggttggccagcctatttgcacacttccatagatggggagatcaccacccctagaggcaacccactccatttgtcagaagcaacagtaacagtaaagatccagactctgcctccctaagtctccaactgggaattccacctttgagtgccctcaagggagaggagactgctgtgaacatccaagcatctggggaacctcatggagagacctcctcagacttccctgcctgcagcagctcaagccccagaacatttcttacttaaagccttgaggtttttttcaagccaaagttgtgagttgaagacagcccagtcaagagtacttttatgaaaatcatctgaatgtctctcacttctgacttcctaatatcaattttttaaagaaatataacttttagacatgtctaggaataattagtgatagcatttattataggatatctctgtggctagcagctgaactgaacactttgcatggattgtgtctttccatattatgtgatcccattttacagatgaggaaactgaggatcagtcaagttacatggttacctaacagcatagagtttgtggcaatgacagaactgagatttgaacctgggcgtctggggcccaagccctgaacctccccaccctctgatccctccagtcatgcaaggatgcccaccgggccccaggactcactgcattgaggccacagagctggtagcaggccatggtgacaatcacggtgaccacctgccagcggacgtagggagctctcagcagctccagcacggacaccaggcggatgctcctctgcacgcggctctcagccaggacctcctctacctcttgggaaacgtctgctttacccaagaacgtttggaaggctgcaaacagaggcacacatggactttcagcagggattagagtgtccatcatgtctaatgctgggccctgcagggacgggtcccacctcctagccacacaccttagctgggggcggaacttggcaggggcctttgaaactatggagtccaaagcccttgtttaaaaatgggaaaacagaggcccagagagatgccatgatttgctcaacatcacccagctggctgggagaaaagctgagaacgtgggtctcttgactgtccgcaacgcaaggcagagcacacccagagttcaaacccgtctataacattgggcagttgtgtccctgttcatcttttgttatcattcctgcctccaatggctgttgtaataattgcatgatatcatatacattcaaccatggctcggagcttcccacactggagttcgtttgctgaatattcactaagcacctcctgtttgcctggctcatgagttcatcctcattgcaggtgtccggagaccagtaggatgtcacttggccaggatgccctgcagtccatgctattgtgaaaagaaggattgagcttaacgactgcaaggccccttccatgtgatcctctgaaatacaagaaaacttgagtggaaatagtcccaaagagtgaatcttaccaggactcaaacccaccctcatgatttatgccttttccatgttgaacactgcaaacttccagcctcagagaacccatcattttttttttaaatgaagaccttaattgtgcaaacctctatgaatgtgtgcttgaaggcgggctgactgattagatcccggaaagcacaataatcagatcatggggtgcacttttggacacagatttcaatgctcagtgctctgatctttcttcctcccacagggaaaggtggctattgtgctggctcctgcggacagtccattccagacacagcaggcagcatccctaaaacatggctccgcccctcagggcgtgtgaaaatgctcttcttaagcaaatgccattaaacttgctccagattctccaagaagcaagaacccttccgaaggctttggagtgttatttccagcagggtactaaaaactgcttcagaatatctttttttatgaactataatttaatgctctccccagcatttattaagggtaaatgagaaaagcagctgaatgagcaatgtttctgtttcatgcattaagtataatatttctactgtttcctcaaagttcaaaatgcaacatctatgtgataaaataactctagacttctggggtagaaaactatttctttccttcatgacatacatattttccattataaaataaggataacttcataacctatgttttttttttctcttttcaccatggctgccaggaagctctcagacaaatgcaatgtttagcccttaacagaatttcctgaaacaaaaaatctctcttctttctcttaaaatttcctatcttccagctccatccatgtccctgcaaaggatatgatgtcattcctttttatggattcatagtattccatggtgtatatgtaccacattttctttatccagtctatcattgatgggcatttgggttgattccatgtcattgctactgtgaacagtgctcagcaaactaacgccggaacagaaaaccgaacaccacatgttctcacttataagtggcagctgaacaatgagaccacatggtcacagggaggggaacaacacacaccagagcccattggggggtggggtggggggagggagagcattagaaaaaatagctaatgcatgcagggcttaatacctaggtgatgggttgataggtgcagcaaaccactatggcgcatgttgacctatgtaacaaacctgcacatcctgcacatgtatcctggaactttaaaatttaaaaaaaaaattctgatcttttcttaaagcttcaatttaaccttcctattgtatatatgttcataaagtgggtgatactgtttcagagtgacccccagcctatgaatgagcaaggaggcagtccaagggcccagccatttctgtccagtgggggacctcctgcaatgcatgagtttctcctgagtttctccagagctctcccctggacttgccaagactttgccaggggcactgtggcctgatagctcctcctgcccagttcttctcccatccttgtcactttccatgtgttattctccattgaaacttctgctctcctaactcgttctcagacctgcttccaggagaacccaaacctgcaccaaggagttacctgccggcgcctcccacacccttcagcccctgcctcttcagtgccctgcaggaccctggcccaagcgcaccagccttctatttccctaactgccaggtaagtccgccccccacccctccatgactccctcactattttcaatcactcctaacaacggcctgttgggatttgggcttggagtcctccctattccacatgcaccctttctggctgagggctcacagatattcttttgaaaatagcaaacatagaagactgagctggagtcctgagggggcaccaaggagggggcatttcaggctgccagagaaggcaggggcactctgggcaggaggcagaaggatggaaagttgtctcctattcctggcactagggaaaagcaagagacattctgtaaggtacatggatgtgctttggtcaaggaataggccgaggcaaacatccaggccagaatgactcagtgagtttaggtgcacaggtgcatactccacttgttatataacctgtttgtgtaagttcatacttggcttggagccactattgtttgggaaggtataactgccctgctgacactgtacgggggctcttgggcatggctccacatgactcttgtgcagctgctggcacccagagaaagagaggagagggataaccagagccgtccattttgcagatggacagaggggagccagggcagggttcggcacagcacggcatggcacggctcacgcttgtgcccagagagagaaagagttaagctgctgaccctgaaggcaagggagagctggccgtgcagctgagcgtgggagcagctggctcaagcagctgagacagaacggacagtgtatgagagctgctgatgagagagctgctgagtaaaaccatattcacctgcttacggccccccgtctgttttttcagctacctgtccatccatccaccctccttgggcctcagttggggctggaacctgacacattcatctgcatatctggctctttcctcaatctggaatgttcttttgacctttctgcacctggctacttgcctcgttctttcagccttatctcagacacctccaggaagccttctctgatgctttcctggctggacgacaagggaggagcaagccgaggagggccttgagtgtttgcacggagatgaagttcctgcccacaggtcacagggggtggcaagacctatagttctgagacccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacacccccaggagcagccctcggttaagacaaagctgatgttaacagaggtatacctagcttcctcacagacacctgagtgagtcctacgctgtcccccagaggtgactgggtgggtggggtcccagttgcccacagctgacacctgctcattattgaacctcaatgcctcctccacttccctgtgccatttcccagctggggaagtgatgcttcctcaattgtaccctctccttccctgtcccatttcccagctggagaagtggtgcttcctcaattgcatcctccatttccctgtcccatttcccagctgggcaagtggtgcttcctcgagtcacctctcaaataaacttcccatcttcaaaaccttgactcaggctttgggggcacctgacaacaatcacaaagtcacctaaactggatgcctgtggtcacataacccagacactgccttccgtgtctgatttgtctgatctagtgactaagccccttcagcgtctacagtccatgtgctcctctctgcctgagcccaggcctgccttagttcaggcctcagcctctccccactgggctcattatccccaggctaatccccaggaagatgattgggccactcttctgcacacaaatctgtgctgtcttgcccttgccagcaggatccagtccaaattctcatctgccatgcagagcctcctcccacggtccctgtggcatctggaggctccccccatctctcttggctgctgccctggaaaaggcactcgtcctccattccacatacccccatggccttgcctctgtgccctgctcgtgctgttccttgtgtccagaacaccctgccactttgttgcctgcctaggacatccttttccgaggatcccctcagcagttacatcttttggagaccttccctgcccccatgatggctaatcactgttaccctctcatccgggtcgctcttgcacctgtgtctgtctctcttgtgcactttcactcttgtctggggcgttctgtctgcacacctgctgtgcccacccctgggagcgccccctgaccaggggccatttaagggatgctgtgttactgtggaaaggggtgggccttggagtcggagcaacctgggcttcacacccagccctgtctctgctaaaagaccccagactagttacctattctgcccgccccatgcttgttcttccatgaaacagaaataataaaacctacctatgaggttgttttggggaataaaatcaatgtgtgttaagtgttggcacataatttgtgttcaataaacaattattgttattttatttcctctctgttgagccttgcatagaatgtacatccaacccatgtgttttgaatgaaatagtaaaaatcaagactcaggtgacagggaaggagaaggagcatgttataaacacagaagcgggggagggctgagcaaacaggaacagaggaaaattatgctagatgtcaaccaaattgcatcagcaggggggccagtatctgttcggtgttctccctactgttccgggcatggtgtgattttccaatggcaggctccccatggtcctcagacaccttcagagcacagcagagtgacagacactgatgcatctgggggtggcccacatacgactgcaagcagatgagatggagcccgccagcctcccttggggtcctcagagagccacgctgttagcacaggtgccatcctggcctggagacccctccaggtgtctgtacacctgctgagcccacacctgggagtgccccctgagcaagagccacttaagggacgttgtggtacagtgggagagggcaggtcttggagctggagaaacctgggcttcacattgtctcagggccaatgggtgctcactaatgcaaacacacattgtctcaggaccagtgggtgttcaccaatgcaaacacacattgtcttgggccaattggtgctcaccaatgcaaacacacattgtttcggggccaatgggtgctcacaaacaaatcctggctgcaccattttctatctagtatgataccaggtgaagtatttaatgtttccatgcctgagtttccttgtctgtaaaataaacataatagcattggtggtgtaaccagtgttcgatgttggcacacacaaagtcctcagaacggtatctggctcttgatgagcaaggagcattatgaatatacatgctatcactgtggggtacttgctacattctccctctccctttcatctttagcctggcagagggtacaaaatgctataaccttctgttgtgggttgaattgtgtcttcataaacatatgctgaagtcctaacccctggtagctgtgaatgtgaacttacttggaaataagacctttgtcaatataattaatatgtaagttatgaggaagtcatactgtaggaggatggactctggatccaatatgactcttgtccttacaagaggagaagagacacagatagatacacacagggaaggcaagcttgtgttcacggaggagaggttggagtgatgcagctgcaagccagggagcaccaaggactgctggtccccgtcggaagccagaagagggagcatggccctgctggcaccttgaccttggacttctggcctccagaactgtgagggaatccatttctgttgttcgatttttttttttttttttttacagagttccgttcttgttgcccagactgcagttcagtgatgcagtctccactcactgcaacctccgcctcccagattcaagtgattcttctgcctcagcctcccaagtagctgagattacaggcatccgccaccacgcctgtatttagtagagatggggtttcaccatgttggtcaggctggtctcgaactcctgacctcaggtgatccacccgcgttggcctcccaaagtgctgggattacaggcgtgagccaccacgcccaaccccatttctattgttgtaagccactaactcatggcactttgttatggcagcagccacactttgtcacctcttttatcacctcctgctagagcaaagcgcagaacaacccggaggcctcttccctcttgtgatcgggggcctgggatgagacaggcaaagggacttcacgtggagcatagggcaatagcctcgtataagttccatgcccagagtggcactgagcttgttctcccttacacagggcaggcctcatgcttctaaaaataggagatttcatcaaagcatttatttttcaatgactaatggaatttaagaggaggaagtcattgggtttttaacttaggttcagtgtgtttttattaccgacagcagttggatccaaggtagggtatgtaacaaggggtgtaggaggagatattggagctcctatttatagctttataacgttttattatggaccgaacctggagccttcacatggcctatgtgactggggatcagggctccaccgtgtggagaagctgacagggtgccttcgatctgtcttttgaatgacatattgctgtttacttgtgcaatttaccagttagcagatttggaaatggtagtatttggtttcaattgaattaaccccaatgaatatacaggtggcttgtaaagaatccccaaaagctgagcatagtagtacatgcctgtatgtagttccaactaatctttttgggaggctgaggtgggaggacctcttgagcccaggagttcgaggccagcctcagcaacacagtgagacctcatctcaagaaaaaaaacaaaacaaaagaaaccacaaattaaaggtaaaactaacaactcccacacaaagaaagacaggacaatcaatagtggaacccgctatctccatttcaggtgcaagcctgctgctagcctcaatgaccattgacagtacgctgcctcacagagattttcaaattcaagatgtagtcaatctgttgcttcaggataaagatgacattttaacaggagtgagaaagtagcaaccttttataagaaactgttccataaaaagagatgtgtctgtcatgtggtttggtagacaaagttatatacacagatcaccaataaaaactcttggatctcagctgggagcagtggctttcgcctgtaatcccagcactttgggaggccaaggcaggcagatcacccgaggtcaggagtttgagaccagcctggccaacgtggtgaaaccccatctctactaaaaatacaaaaaaattagctgggcgtggtggcgggtgcctgttgtcccagctactcgggaggctgaggcaggagaatcgcttgaacccgggaggtggaggttgcagtgagccgaaagtgcatcactgcactcccgcctgggtgacagagcaagactccttctcaaaagcaaacaaacaaacaaacaaacaaaaaactctcggatctgcacattcaaaaagaaaaacttgcaagcagtttaaaaaactttctgtttaaacatattccgaatgaaaagtttcagtaggttttgctaaatgattattgttaaaatataaaaaggcaacaacttcttactactcagcaaggacagtggttgatactaaggaagatggaaattcactggcctgcattttcaactcccaaaacatttcattcctgatggacgggattacaggttgaagccgcttcatcaagttcagccagccttgtcacctgcttctgtttggagctacatcgtttaatgaggttcatttttgagctatccacgttgcaataacattggtcaccacttgctaagggttcccttgtgttttatgtgcccttattcatttaattctcgtataactatcccctgaagtagacacagtcagtattcccactttgcaggtgagaagatgaagcttgcacatgggcagtgacactggatgccctcgcagcagagcctgagacacatgctgggtgtgggaagtttaccggctggagagcaaggcagtccaaggtgcatcttggggagacttctatgggcaaagggcatcagttctgcggggcttctgagcagcacatggaatacctccagaactgtcccacaggggaagatggggcatttatctgccagctcctgcccccaggggtattaactccctgaatgtctacactgcgctgcagatggctgagcagcttcctggccatggagagggcctgagcatttggagaggcacgtgctgtgcttaaggtgggcaaacattggcccatacctgagcccacatggactgtctgctgcagcaaggctgaaattagagtgggcagagggagggtgtgagggggacactagaaggggctagtgctgtcattcagcaggggagcggaggagcgagaattacaacccacaccggggctccagaagtatcattttcccaatgtccagcaatgcttcctggaagctcagccagctggggctgctataacatcatactacagatgggtggtttagacaacagacttcacagtcctggaggccagaagttcgagaccagggtgtccgcagagtcagctccctggtgaaagcctcttcctggctgcagacactgccttctcacttctctggaggcaccaccctcatgacctcagccagccctcccaaagactcccctccaaagaccatcactctggggagctggggcttccagatacaaattaggggtggtgaggagcacaaacattcagaccatgacagcaacttagaatcagacccttcagagctttggaatgctgtcctccccgcaaatcctgcctgtctctctcccctcccctctccttcctcccttccacctttcctcctctctctctcagtctcatctgaaattgaaagacactcatcatgctctctggttttcacccaaccttcccttcaccatcactttcatcagagcaagacggatatctgtgttgcaagtttagcaaatgccaggtcttcccctaaagacgggtggaaggaaatgtagctcctcacaggcccagggtgaaaaagagggtaggagggagagccagaaagtcctctctgtgcttccaacatgtcacagaattggtgctaaacttgcaattgcctgtagtgcagtgttgggggtgtgctgtgattggtacgtggccacacctgtgctggctcctgtcctcacagtcctgtcagctcggggcagcgcttgcactaggggaaggctcatggcagatgcttcatggaagaggttggttttcctctgggtctagaatgcagaggtgctcacagcatgctggatgaaggtaatgaacctactcatatttgcagatgtctagtctgcagaaaagagtttcccaagaggagatgcctggattggatttgctttccttggctctgaggtcagaacaagggctccaggcaagagctctgatgtgtgggaccacaaggaagaactgcctgatggatgtgtccaaggatgaacgtgttttttgcacagtgagttccccatccctgaaggtgtgcaagaggagccaggtgaccacctgtcaatcatattgtggaagggacccaggcactggagaggaagatgaacaacagggtctctaaagcaagcccagaaccccagatgtgtgcaggctgtgtagatgattggaaggagatggggcaatgtcacccatggggtgggaggggacagagctgatacctccagtttaaactggctgcccttggagagagaggaaatggcctgggaaattgctatctatcagcccatttaaaaattacatgagtttatggaaggtaactctctcagaggagttcattctcttcactctccaagtcatttaaaaatagttcatccaagccctaccccctgaatgcatgttccccacattctcccttcaatttgaaagtaagagggcttcctgtggctcatacctcatgcatattcctagccatgttctaatcactaactccaaagaacttgaaagaggaatgagaaattgcatttcccaactgggaaaaaaacctctgtgtagcatggcaaactcctgggctgggagagggagctgttacataatcagatcttgccccagttacagattcaactttattcaagaggagtcaagagacactgagcaggggagaagaggctaaggtttattgtgtacctactgtatgccaggctttgtgcgaggtgtcttacagaaacagcccttcaaggcgagtgtgtttcagtccacagcttcagggaggtgaggaaatgtgccagtgttcgcccaggtaatagtgaggagttcatgctctgacctagatctgtctgatctttctttccacacacctcacaagaaatctcagggctgagaggctaaggagccaaattcagctcattgccattatccggcagcttgtgagagcttgctgtgcatctgggatggcgtgcaaagatccactgtgttaagggaagaacaaggaacgggttctgctcccaggaggtctctagtgagagacagacacgactcactaccacttgagttggtggggcttgatgccacatggagagtgactgcagggagacctgaaatgagaatgactctctctctctctctctctctctctctctctctctctctctctctctctatatatatatatatatatatatatatatatatatatgccttgcctgacttggaaaatctctctcatgaggaaacctctccagaacagaggtagaaactatcaagacagaaacatcacagaaggcccaaagcaatgatctaaaatatttcccttgtaaaaatggcactctctctctctttctccatgcctgcttctcctctgggtgaaactgcttcatgttcccacagcaagtaagtctccatccaattgctataaacacctccaagaatgtactacagagctttaagcagcagcgtgctacagactgtactcagcctttggtatactttggttttcttcattcatgcaacaattatttagtaagtaaatgcctactgtatgccaggcactgctctaggtgctggggtttcagcaataagtaaaataggaaaagtgtccctcctcgcatggagcttttcattctcatggaggggagtgatactaagcaaattcatttataaacatatcatttcaggtcataatgagtgctaaaaagaaaaataaatcaaggtaagtggcagtgagaagaggggacactgagctatggcagctgggggagatgtttttgagaagatgctatttcactagagacctaaaggaagtgagggaggtgtgggtcatgcagacatctggggaaagagccttccaggcgaaggagccagtgcacaggtgctgagatgaaatgtgctgacagcatcccactacttatgaacttgttgcatttgccctattgggactcagccccacaaccacccttttagaactcttctgtgtcatgggggctagcagcctacaaactgcctgtccttactccctataaatgatatctccttactcccatgctagcagagtcctgttagattccagcagtgagaggcactgatgcatcgttagaggaagaaaggacctcttctgctagtcaaagttccagcaccatcagctgtggctcctggttagcctcagaggctgtggttcccacgtcatctgtgccaagaacatcagccacgttaacgagagcagctccagcatctgccctgctgccacagtcatgcttccagcagtgtcagtaagagatgggatcagttcttgaacccaaactcacctggcatcaaaactggctctgtaagaccacagaatctgggatatgcatggtgtggcccaaaaaggaggacaaagtttgacacaaatggaatgtgactggaggagagtagctgaactcagcctcggcaaagaggagcttcttttaggcttcagaaattagaagtgagccaatgccaatgcaactctttcattttgcagagaggtgagcactttgaggccactgggcaggccagtggctgagctgggactgagccctttctcctggaaaggggagggagggtgaacgcacgggctccagggtgactctgcccaactccttttgctctcccagccctactggcacctctgtaaccatttcctggcatccagtgcctctctgaaatattatttccactttcctgggtggaacattgaccaatgcactagctctgtgaccttgacatttcctcgctgagtcttagtcttctcatctataaagcaaaaggtagaaaatgtgtagactttaggggggtgaggactaaggtaatggttgccatgtacctagctctattcacttcctcttgctgctacagcaaattacaatggagatttatcatcttccagttctggaggtcagaatctgaagcaggtgtcactggattaaaattgagtgttgcagggctgtgttccttctggaggctctagggagaatccgcctgcttgtcttttccagctcctatggtccacctgcactccttggctcctggtcccattcctccatcttcaatgccagcaaccttgggccaactccttctcagattgccacttctctggttctctctctctttgcctcctttttccacttataagaacccttgtgattgcattgggcttaccctggtagtccaggactactcattccaaagtcagctgatgagcagccttaattccatctgtgaccttaattccatctgtggccctaattccttcatcatgtaacctaacatattcacaggttctgggaagaaggaagtggacatctttcagggtggggtggaggtcattattctgcctcccacactagcatataagaggaactcaaacaaaggaagccatgagatctcccaatcaaatcccctctttgtacaaagcaaaattcacagctttgtctgcccactgtaccactccacctgggtaagcacaaaaatgatgccaagtagatgaagacactatgtgtctatcgggaccactggagcagatgcttccctgggtagctggacactttcttgaccacagatggcttttcattttttctcaaactactttgccctgcttcttgtgtcccaaaacagctatgtccctaagacactgtctgatggcagaacaagaatcctcactgttcttggaggaagtttccatcctgacagaggtctgggattgttgctggaaaggccctttggtaccatccagcactatcctagccatgagcagatgaggaaacagtcatctggagagatgcatgatggccagttagtagcagagctggatttaccatggggaattttttaatttttattttactttaagttccaggatacatgtgcagaatgtacaggtttgttacataaataaacatctgccatggcggtttgctgtacctatcaacctgtcgtctaggttttaagtcctgcatgcattagctatttgtcctaatgctctccctcccctcagcccctgcccacaggccctggtgtgtgttgttcccctccctgtgtccatatgttctcattgttcagctcccacttatgagtgagagcatgcggtgtttggttttctgttcctgtgttagtttgctgaggacaatagctttcagcttcatccatgtccctgcaaagaatatgatctaattcctttttatggctacatagtattccatggtatatatgcaccatattttcttcatccagtctatcattgatgggcatttggattggttccatgtctttgctattgtaaacagtgctgcaataaacatatatatgcatgtgtctttacagtacaatgatttatattcctttgggtatatgcccagtaatgggattgctgggtcaaatcttatttctggttctagatccttgaggaatcaccacactgccttcctcaatggttgaactaatttacattcccaccaacagtgtaaaagtgttcctatttcttactggggggttttgagcccacttagtgctcattctgtgctgtctcactgtccctcggagggggagcaatgacacttacaaccacctgctgtgggagcctatgggtggtggcagagcccgaacacctgcttccaggagccttgggcctgacactagtccctgcccctatgtgccctggttctgacctcagaacctggagctgagctggttcttagagagcatcttgttctacttctgatggtgcaggtagagaaacacagcccagagaggtgttgtgaccaaaccagaactcctgacccctgcccagtgtcaacactcagatcccacagtctctctgcacctgctatgtggaagaactcaacaagattgctgtccaagaagtcattggtgaggaagcccaggagatgctgcatgttgttttaggacgtgtgcccctgaacatatgctcccagcaccgtctcgcctgcagatgcacccagtcaaacctgatgggtcccaggacctcacgctgggggcttaacagtttccattccactctttcctgcaggaagctctgtggctcataaaacattaaaatgagcactgctgccatttcatgaaatgcccagcctgtgaagaatgggttaagggatttttgggagctgttgtgtctgaacacaccaggcacatctgggaggcacatctatgaatctccttcctcattagcatggcagctcttcaccctagggccccagatggggcagttgtcttacgctgcctcctgcgagaaattggagcccttctgccaaaataccattgctatgggtggaatgtttgtgccccccagaagtaaaaagttgaaaatgaatccccaaactgatggtatcaggaggtggggcctttggggaggtgatcaggtcgggggtgcagaatccttacgaacaggattcatgcctttataaaagagaattacaaagcactctgatatccatgatctgatatgatcatttctctgggccctagagataagcattcacaggcaagaaaactgagcctttgagataacgggcagctttcctgagtcacacagctgtggtatggggaagacggggctggaccccagctctgctaactctcagctaaccctgggccacatgctgtgacacacagtaggccttccagagagccagggagcatgatgatactagcagcaacattaccaggtacaaagaggggaagaaaagtgtgtcaacttcacggctgacaccagaatgtttctcaagcactgtcatggctaagaaaaatatttagatgaatgtctggagcagcaggtgtctgctgaatgtctgcatgtgtgctggttccagctacagaaggggcgggaaggcgctcgacatgctagagggaggagaaatcggggctccaggggcatctaagaaagcagaggggatgatgagcagagatgacagggagaggaaagaggaggctgtgagtggcaggatggagtgactcccccaccaccctgaaatctttgatatggtctctaaactctctggtgatttgttgtacatgggtgctgttgtttttgagaaaaccaaagaaggtactgaatttcaagttgggactatcatgtcatcccaagagcaacagaactggtccccaagaagcagaggagactcaaagcacagggatgctctgaatggtaaagaaatgttgaacttccttccctgtgctgtggaattgaaggtacgttgagaacttcctcccagctctcaggggcacagagacctccagcaatctcaaaggttgcacgggaatggcacccatcacaggcacaacatagaaaacatcctctgcttcagcaaaaccctaagcaattctctaaatctaaagtgaggctggtccttacagcaagagttgcttgttctttaaaacgaagaagtgtgtgggcaatttctaggaacgacttcgtgctctgagggctggaggctttggtagggtggtttccgagctgtgttttcccgcccctttttggcccttgggttttctgtaggagacatttatctctgtgggcctctgtttcttcactcagcaccctgtcccaacaagttctctctagccagggaaaagggagtcctggggcttagctagtccatgggccaaaatgagaagactctcagaggccacctatcttggctcacatcttagaaatgaaacagagtaacagtgagggaggagggcgctggtcttccgggagcaggtgactgccagcagagaccgagagaagacctctgaggcagtgcgtccccacctccctctgcccagctccctctgcccggtttaggagatggggacatctttatcattgacaagggcaagcatggaacgttacacagcccctcttctctcctcagccatctccagatgggtataggtgagctgagggcctccaggtaaggccaccacagacagcagggcctgaagagccagctgatcaccccgtggcctccttcctgggttctgcgttggttgttggtgggtgtgtttggtgcacaggtgagggagtaagcgaggagtttacctctgttgcccctccctcagcaagagcctacaaagcacaaagcccagctccctcaagcatcagcggcctccgtttgtgcctgcatttacctgggcctgcccgtatctatgatgtccacacttctgtgatcacacagattctttttatgttctctttgttcccccccgaacattatgtcctaagcatgccttcataatgctacaatcatctataattgtttgttaaataagtgaattaaattggcattgggatatcattttcagttttaagcagatacacgattacttatctaactgttcttagatgaaatggatgcaaatctggaatttaaccctggcttaatatataaagtcataatatttcaggagaaattttctgtgtctccaacccatggattaatgatcttttgctatttttttttttttttttttgagatggagtctcactctgttgcccaggctggagtgcagtggtgtgatcttggctcactgtaagctctgcctcccaggttcacgccattctcttgcctcagcctccagagtagctgggactacaggcgcctgccaacacgcccggctaattttttttatttttagtagaaacagggtttcaccgtgttagccaggatggtctcgatctcctgacctcatgatctgcccacctcggcctcccaaagtgctgggattacaggcgtgagccactgcgcctggccgatcttttgctattatggttgtctttatgtgcacgttatgtcttataaataagagtcacacacacgctcaaggcagcaccctgcacttcagtgaattcaggtttgaatgagacaaactgagttagaatctcgcttctgtgatgaactatctgtggtatcttaggcaagctactcagcctctgagtggtcatttccttgtctgcaaagttttggagatcacagaagcaaagcaccatgtgtattgcaggcactggaggctgggattctcctaaactgacaagggtggcataaataaataagacccagggcctgggactcattccctgccactatgaactgggggtggggatggagtggggataggaacatcccgaaaggggcctcttgtctgaagtgattgtgttgatggcccaagttcgtggcctccctacgtttatgtcctctaccctaaaactttgaagccccttccactctgactttgggttagctatgtgacttactttggccaataggattttaggagatttcaagcttagagaaaacgcttgtgttttccatttcctctctgattaccatgagaatgtgccctgctggccagctggggatgaggtgcattgaacagagctaaggccaacctaggtcagccaggtgaccaacagacatgcgagtgaacttcagctggccccaagaaagattttaaggtcaagccctactaagattaacagaacaacactgttgacctataggtttgtgaactggggcatgctattatctaaagccaatgtgttttgggtgttttgttatgcagcattattacagtaatagttgactaacacagggcctcttttccccaaattatcaacagactggagaaggggtatctcccacagtgccgagcatggtgctaagtaataaagtgcattttgtttacattcataagttccagagccagactgtcagaattcaaatttcggtgctgtcattggctagctttatgtccttggccaagttatcccatccttggtttttttttttaggtcttaaaatgggaataaaaatattacctactttctatggttgttgtgatgatttaatgagctaatgtatgtgaagtgcttagaatgaaatagttttcaatacagatgagccattagtgggtgtttctgtccatctcccttaactagaccttcaccctccctcactcctggggggcaggaatgtcatctcataccactgtctcaccctgtcacctggcagaacacccaacatgctaaatatccattgcttgctgaatgtctggagtaaaattagcacttttataggtacagatgaaaatttcaataagctatttcaacttaaggccaatatctttgttctttttatagagtgcacatgtaatatttatcacgttttgtaactgtacttctccctcactccctactgtgctatgaaataaaactttaaaaccttcttcactgtctggcattgacatgcactattcattccaactgtacttaattgaagcatttctcaagagagccagagggggtgcgggttaccctcccaggctagtagagacagagctggaggcctcaccctcttccaataatgcacagcccaggtgcatctagaatcagatccccttggttctctctcttagtcaccttctttttactccagagactctgccatctgacaaccatctgaaccaaacttttaggtggtttttctcctcactggccacatgggaagtcacccggtacaatagccactacttccgtttcctggtatctctctgtgcacgaggggtgttggaggaaaatcttctttgggttccaatcctttggttactaacgggtttaagattgggggtgggagttactaaccagggtcctctggagaaaagagggctcaagtcccaggtctatcaccaagccataggcagaattttgtgtatatggttactgtattgaagaaaacactatcatttccatcatattttcaaaagcctctataaatctctataaaccaaaacccacagctttgggaaacggaattcatccctgtaagcctcagtttcttcatctgcaaaatgaaggtaataacaattaccttctctgacttcactttagagaaatgttataaatgagaaaatgaatctgatccataaactgctagacaaatataggtaattgttaatatttcattatgccatttgttaactcagaaaatacttaggtagtgtgaatttcaaaagatgttgcacaaattgtatatataattctcaagtcttttcctggatttggacatagatgaaatttagaactaaaatgcacagagttctcagtaataatgatagcagataatactacgaaccttatatgcaccatctaattcagtcctcacaatggccccatgagggaagtttatgtcatttcctttttacagatgagggttctggggctcagaaaggtttaaaaaattgctcaaggtcagacatcagagctggatgtgaaggtagtgctggttaccttcacatgcctaactaaccatggtgctgtcaactgcatctcattttataaaactaaaagaatcagaatgtgattgttcattctgcattgtctatctctaggcaacataattttgccttttcagggctctgtagagagatgtctctgattccgaaagccaagatttgaatctgactcagcatccccccatttagggcatttaaagaaagctacatgagacaactcccaagcccctttgcgagccttatttttctcccctgtaaaatgagtgtatactccttcctccctcgaaggactgttggcaaggtcctgtgggtcattgtgaagaagcactcagaccagtgcctggtgggatctggtgttcactctgtgcttgcatcttttcctctcctggcaggtaaatattaagacagaggaagtcagtgaagggagaagaagtggaaggagggccgccatgcacctaagccactcagaaatttcagatggcttcatctctgtggctgggaacaactagagaggtggtagtgagacactgcacagaagtgagggaacctgcgtcttatcttgtctgttctggcttttccagattccctgggagactccctgggtgactctgtgtcccctctctgtcccccagcaaggctgttgggaagatgaaatgagaaggtaccctatgatacccagcccagtgcctgcaaaaaggaacaatgacaacaccccttcctgtgcccattggcccaggtcccagcatgccttgcagtgatgatctatgcaggggctggagctgtgcaggaaagggaagggccctcacctttcacagctcttgcctcgttgtgcttctccaagagcaggtagcgtgggctgtccgggagaaagggaaggctcagcagctggacaacggcagggaccacaatcactccaaacaggtatggccaggtactctcctgtgggagaaggagatgctgctgagtgcagtggcctttggtcattgttgaggggactgggccactggaccaggtggtttcgaccctgcagaaggtcttcctgcccagcatgatccccaggaacaaaggctgagggaaggaactgagccaggctgggcaccagtcccacgtatatagcattttccatgcatgagtccagagactcctcaagagtcccctgtgagatagtgacctgcaaggtagctctgaaaagcaggcggctctggttggccaaggccactcaagggctgcttgaccccactccctggggaaccatggtgagcctgggggatcttagggtctccttctcttcaacaccagggctgcctcccaggctgccccaagaatggagcctgcatgtggaggtgacatgggcaccaccgctagatatctagacgcccacgacattcaaccatctctgtcttctcagtgaggacacaagaagggcagctggagctcttgcagaccccatgggagtgaggaagagggggccagtggggcacagcttaccccttagggagaggaggcctttcactttccagccagctatgaaaggcaaacagatccctacgacacgcactattcaagaggcaagtgatgcactccaagcagtgacatcccctgcagtgcagcttaaatgaagcccagagcacacgttacgatgcccatcaaggtagtattcgtcctaacctgctttcttcctacccaagtttacaaataggctctcagtgtgccactgaaagaagagaatcctgctcacaatgcagttctgatcatgagaaggaggaaaaaccaagtcctcaatgccacatccttgacacgtttatttcccaagaaggtacaaggagatggccaagggcaaaataagacacactcagacctgaaaagacttcacatgataggcagaggttctgttggcttcaggtggggcccatgggaagttaccctcaggatcctggggcaccagaactggcagggcctggggacagcctccccacctctcccccagctgcccgctgggaggcagggcttccctctgctgctctcccaagactcgctccctactgaggtccatggtaacagagacttttgcaagttctaggatcccatgaagggagagcagcagggccccagggctcagagtgagtggggaagtggcctgccaggggcacacagccagcagctggtccaatcatcatctccatctaaggggtgccttagatttgattcccttttctgtatctaataacaatttttattcacaaaactcctctggttccgccagccagcatagcccttccatcgccctttgaggaactggcaaggccaatgtcagctttccagtttcaggaggagctctcgctagaaggctgggaggggtaggctagggctgtcgggggcccaggagggccagggacaggggagtggggagtgactgcgcatgggtgtggggtttcatctagggtgatgcaaataccctggaattagggaaggccgatggtggcccgactccgtgaagataccaaaacccactgagctgtatactttaaaaggatgaattttatgatatgtgtgtcatagtttgatcaaaaagaaagaccaggaagaaaaaaccccaacatacatagaagtggaattttcgctaggcctgtgtgtggtggtgttgattttattttctctcggggtttggctgccgtctcagtaagggtaaaaacagaatctgagaaaacacgagggaaccaaccccatgaagctcctaccacgtgccggatgtgatgtgagcccttcccatggctgtctccttccaccgcacagccgccagccccacacacagccagcaatactgctgcatgttaaaggtgtggcaggcgattcctgtgctgaggcctcccagccaggagccacacaggtggaaatcaagcctaatattttcccacagtatcgtcacagtgggagcacttcccaggggtggtgtttttggagctgccactgggtggaagggcacccccagcataggaacagcatgtataaccacacagaggcatgatccacccaggctcattggggaacaacaactgtagtggaaacagaaggtcaggggatgccggagatgtgggagctgaggctggagccttgagcagaggtcaggtcatgggtggctttgctgcctttccatggctcttggacttggcttgaggacaacaggagcctttgaggggtctatgcactagctgagatggacactctctatttccttgaatctacaattcagtgtttttggaatcttagtcagtgggtatgtttcacattgcatgacttattcctgaaaggctgttatcaagtttatggcatagcctttgatccctggtctcttaaatacaaggacgtgtggactctttcttaaggggggtcgcatgggtgaccatggtcttctttctacctctggagaaaaggtggattctttaaacctcagggtgggcagcccccggattgggatgccaacatttctgaactggggaaggacaatggcagtggccactctgcacacatccctggggtgaacagcggaaaaggtgagggtcgggagtgtccagagtggagctcagataagagtttactccagagggactgagcttagccagcagaagagtctgaacctggctttttccagcaagtgttcagagatttcctggagatattagctggctgcagggagaggtgttatagttaggagagattattcccctcaccttctaccaagaaaagtgtgactgggtgtgtgggtagggtgtgtgttgaatgaagtgtttccacccatattatacatgtggcccacccaaataataaaaatagctaggatgacctgcgcacacgtcatctcaatgagtaagtgcctagcctgctcactcattcctgccgtggggccacaataaaggctctgctatgccctgtgctttatggaagaatttctgacaatgaacatgcacgtcttctctcccaatgacagtggtaaagatgtaatcgccatcagcaacccttactgagcaggggcttgcagccaggatcagggcaacctagtgagtggctatgggcacagctctcttgcaggctgtctggatttgaattctgcctctacccccactcactgtgctgtgggcaagttatcgaaatgcctatgcctcagtgttctcatctgtaaaatggggacagtgacaacacgtattcctagggaggatttctgttgggaggatttagtccatgaatggatgtcgggagtgctgagcacaggcctgcacacactgtaggtgttcaacaggaaagagtggcttttattactaagcacattggatagttcatctcttctcatcctcacaatagctcgcagacagagagcctgtgattatctccactatacagaaatattaactgcagcacagaggggttcaatagctcattgaggccacaactcggtcatagaggcatgactggccgccaaatctgggatcccagagtctgaattcaaatccaggaggcctgataagacatacctagtgaccagggaggagccatcagaccaccagactcaggggaagggccaggagagcttggtctgaacttctaccatctgacccaggcctaagaccctcagtggcccttgatggagctcctgggcacttggtcccaacacagagctgaggcctcagtgttttacattagatgggcatggcctgaaggcagagacctgctagcacacagtagtggttcaatacatgtctattgaaggagcaaatcagcgtgggaaagggctttcctacacactggtccctttcacaaacagcgcttgccattttcagacagtggcctctgagtgtctttttcaggtgctgttcaaaaaggaaggcatgttttaaaaaaccgcatattactcgcctgacacaagaccatgaggcgccaccaaacgacaacctcaaagatgagtctttgtggtgtcggtccagcctgctgggtttggtaaagccctagagcgtccatctaggagaacacaggcagagtctttgcacctgctatttcactcaggaggaaagaaaaggatagtcttgtcagccaaggtgatttttaactcccagtcaggtcaggcgaatgggctttgcaattatcttgttctattatcttgttctttaatctgcaggtttccatgttttaaatagacttccaggtcatatttcccccaagctatagactactttagtccataaataatatcatcctggactatgatgaatcagcaaaaaatgtttaagtagagttgaaatcattactcttaccccaagtcaagttcttataaaggatgttccaatatgctcatggcccccagacaagggagcacggtgagggggttgatgctggctgggccacttatgcctctgacagcaaaagggctccagaagtggccattgctccatgctgctggattggaaaggggaagagcaagccctaccttacacagctatttgggggattaaatgaaatgctcttctttatatttcttcatatttaggctcttattctaataatggcttacattgatcaagtgggctccacgtgcccagctccctgctaagtgtgttacaaatgtaaccttgtgttacataagaacagtccagaatgtcatctaaatacaaccttgatctttgtctccttattcctctaaaatttaatccctggggctttatttccctgccccattctaggggctcatgtcttttctgctgaaactgagcagagtcctatcctagaatcacaatttcaatttagacatcagaattgccagtataaaataataatcaaaatcaactgaattgaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttccgagggttctggagtgtcccaaccttgggaccacccactcgtccttgcagttgtcctagcctgcaggtttgcaggtgctctttctctgtctctgctgcaaggtgtacatctctttctgtctctctccattgcagctcaagggatccagggtcaaggctgctctgcatatttgtgaaaggtgcaccgagcactcagctccctgataagggggtgggctgaggctaaatccagcccactctgaccccaacctaggtggccatgaggttagtgtattaatattaatcatgttttatgtgttctgtattttatttcgctttcatattgtatgacctttctgatttcagagagaccgacctttcccgagcagttattaatagcagctccctagctattaataattcctagagctagtaaacaacctgcctgagagcaggcctttcgtatgcaaacccaccaatccaaagtctatactccaatcacttcctttatcaaactctcacactctgagccaacatttcccctcccacaggccactccagagccaggtatcagacaactagggaacagccctgtagcccagagcctggcaacatgatctcaagcctgcctcccctgctcactcattcctgccatggggccacaataaaggctctggtgcaggctgtcccctccctctttctgcctcctgactgacccagtgcttccctgcgtggtcctgcatggcgtggtatgtcccctcctctagggaactgtgagtaataaattcttctttcagataaggttgcctccatgtccatcacctcgccatacaggattcatacaaattctgggtacattttagaacagctggttgcccctcccactcaggcatgtatgttcttgctgtaggtggccacttatttctttctaaacaccacccccccaccccttaccttccatgacacactctccctggttctcctccagcttctcgggatacttatccaaggttttgaggcaagccctcctctcattcatctcacacacatcccccgggtagtgattcttgaacttggctgcccattggaatcacttggagagtttttacaaactactgatactcattccttactctcagagatttggggttaattggtctgggggtgcggcttaggtgctggggttgttcaagctctccaggtgactctaatgtagagctatttgacggccactgtcctagggcttcccccacacctgcgtcacctgcagtgaatggtggtgcatggcccagaactgacaagcttgacttatagctgctgggagcattactggctgtggaccacagctgggcctgtcctctggaattgcccttgaaggatgtttcctccaccaaggctacccagccctccccaagaacaaactgcatccaatggctgactgatgtgggggcataaagttctgttcccccacctccaaattatcccactctgatgggccatcccagctccagagctccctgtgggctcaactgagacctctgttgtgctgagggttgctcaccttttccctctgctgaatcctggtcccatctcttcccctgcaggcactgatctgagctcattctccaatcagcttcctgcccacatctccatctcagggtctcttttctggggaactcaacctaagacacatctatgggcccatgattccaaatcttcatgtccatccacacatctgacaaaaattatttacttggccaaacattagtcagcccattgaaacttctcctaggcccatctgtgtacttccctgtaaaatacagctttagcaaaggacgctcctaggccattttagcaagaacccctttctgcagcacatctatctactcatcctttaccttatagcattccctcccgtggatgacttctctatctggtaccaatttccattaaagcacttgttattctgcatagcaatgtgctttttatgggtgtgtttccctatagacggagctcctgaagggccacccattgccttgttcctttatttatctgcccagtgccaggtaaaaggcaggtgtttagtaaatgcctgtttactgaatgcatgttggggaggatgaatgacagcacagataagagatgctccagctagatacagaaatccctgaaacgacagacactcctgctcttaaaatactttttataaaaatgctaaaactgtcctatatgttgtcctattagagggctgatgttttatagtattataaataatattttcccacaaagtattattataatttctagtccatagaagagaaaatgtagacctgtaaaggtcaggtaactcatgccaaggcacatgagaaattagggggtctggcagaacaagagcctggctcttctgatccctgtacggggctctttccttgacattattcctcagatctgcagttcctggagcaaagcactgctgccttgccaccttcccttccctcatggtggcagctgctagctgaatagggaatttatatgcagattctatcaggctgaacctgtcacactcctctatggcaggtcctatacagaactcatcagtgatcactcaagctcaactccaatagctcatgctattacaaaaacatcaagatagtgaagcctgcactcacattccatagggttgctttgttacatctttgaatgcttcctgcttgtttagcagtggggcctcacagggaaatagtgacagccagcaaatgttcatggagcttctttgaccttaccgtccctcccaacaactgcctcctgggaaggaccctgctggccacagctttactgaatcctggggtggggagcatgtggctggtcgtgtttgccttaccaaccttacctgttgggcatgagggtcaatgtcaccctctccacacctgaccccacagagtacaagccagctagtaagatggctcaattcattgcagcaaatatgttgttctagaattgctatttttggtgcgcattcatgctctgattctatttcaacactaacaataacaggtatctcaagaacatgggcttttgtgattacctctcatttttctctgttggaaataataatgagatgaacttccaaggctacaacactcaccacacaaaaagtggttttgagaattggatgtgagagaagcacccacatagagcccccccatgggtcatctttcaagaaatgctccttcccctattcctaaaacattttctatttttcaaagggtttggatgtcctctgccttgcttggttctcaagcaatcttatgggaaaaaatgctcaatatcactaatcatcagagaaatggaaatcaaaaccgcaatgagatatcatctcacccctgtcaaaatggctattattaaatgacagatgctggcaaggatgcagagaaaaaggaaaacttaaacactgttcatgggaacgtaaactagtatagctgtgaaagaaaacagtatggagagatcgagaccatcctggctaacacggtgaaaccctgtctctactaaaaatacaaaaaattagccgggcgtggtagcgggcgcctgtagtctcagctactcgggaggctgaggcaggagaatggcgtgaacccgggaggcggagcttgcagtgagccgagatcgcgccactgcacgccagcctgggcgacagagcgagactccgtctcaaaaaaaaaaaaaaaaaaaaaaaaaaagaaaacagtatggagatttctcaaaaaactaaaaatacaattaccattcaatccagcaatctcacctctgggtactactcaaaggaaaagaaattcatacgtcaaagggatacctgtactcacatgtttattgcagtactattcacaatagtaaagatatggaatcaacctaagtgtccatcaatggatgaataaagaaactttggtatatatacatcatggaatactatttagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaaggaataaatccaatgtttgatagcagggtaggataactaaagttaacaaaaatgtattttattcaggtgatggataccttaaatattctgactcaatcaccacacaaatatgtgtaacaaaatttcacacataccccataaatttgtacagataataaagaattataattgccatatcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcagaaaaggacaggaaatttacaaaagattcatttaatgtttggatgaatggttgcagaattagagtaggtatcaaagcagtggggttaagctgactgcctggaaggcagaggctaaagcactgtggcttccatgtgccacggctcagctcataagactcccaatgccacagaagccaagaaagagagtgccctctggagttggcccacctctgaggttgggtcctgaaccctggtcctgccacttactgattgtgagataacagataaaccacttcacccctctactcctcagtttgctcatccgtaaagtttagtccacagaggaggacctcacatgcagtaggggctttataagtgcttgacataattcgaatatatgtccctgccaaatatcatgttgaattataatcgccgatgttggaggtggggcttggtggaaggtgtttgggttatggggttggatccctcatggcttagtgctgtcctcatgatggtgaatgagttctcccaagatttggttgtttaaaatttgtggcaccttccctagccttacttctgcttttgccaggtgatgtgcctgctcctggagccctccccagaagctgagcaggtgccagtgccatgcatgtacagtctgcagaaccatgagccaattaaacctcttttctttataaattaccctgtctcagatctgtctgtcttttttttttttttaaagacaggatctcattcagtctcccaggctgtagtgcagtgacgcaatctcagctcactgcatccccaacctcctaggctcctcccaccttagcctcccggtagctaggactacaggcatgcaccaccaaggccagctaatttctgtattttttgtagagatgggatttcaccatgttgcccaggctggtctcaaacccctgggttcaagcgatctgcctgccacagcttcccagaatgctgggattaccggcgtgagtcaggtgtttacagccgtgcaagaatggccaaatacaatgtttgataaataatagaaataacaatgtcagagctgttttggaagagatttctgcattccagaagcggtcgggtcattttctgctatggtcaatttctattcacagattctgtgatctgaatgtcctataactctaacaagctgtaattcttgcattgtaagatgctttgcaaaagtcctagaatcatacacttgtgattttaatgttctatatccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcattgggcagtgacgagaggtcccacactgtatcatctgcctgtctcaaatctcagccacatgctgttgcttaaagagctggagccactgagggccaggtgggcccagatgtgggcactggtgccttgcccatctgagtttgagtcctctcctcactgcactgcctgctcccttggtcattttggacctcaaatttaaatttaacctctatgagcctcactttccttatcaataaaatagagataataaaacctgcattactggttgtgctggggattcaacagattacatgcaaagtgctcagcctaatgcccagtttaggagttttttgtttgttggttgttttttgagacagggtctcactctgttacccaggctggagtacaggggtgcaatcatggctcactgcagccttgacttcccaggctcaggtggttctcccacctcagcttcctgagcagctaagatggcaggcatgcactaccgtgcccagctaaattttgtttgtttgtttgtttgtttgcttgtttgtttgagatggagttttgcttttgttgcccaggatggagtgcaacggcaacatcttggctcactacaacctccacctcctgggctcaagcaattctcctgcctcagcctcccgagtagctgggattacaggcatgagccaccatgcccggctgattttgtatttttggtagagacagggtttctccttgttggtcaggctggtctctgactcccgacctcaggtgatccacccacctcagcctcccaaagtgctgggattacaggcttgagccactgcgcccagccctaattttttgtagagatgaggttttgccatgttgcccaggccggtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattccccaccaggaatgtcaggtggccatcaggtgatggtcaggcagttgttaaactgtctctctaaaataatagttggtcacagctggcaattattgggaaaggcagtcagtctcccaatagaaaaaaacctaaaactggtgatcataagcttcccgacaagatctcaggagttgggcgagtgggctcaagcatatgcacgaagaggcaaaatggcagagtttacctggtatatggccttcctctgggaacttttgactggtgagggaaaaacgcctcaagtcagcatgtgcacaacgtcagtaaacacacggcgtgtgcggcccctcctaagtgctggcaggccactgtgcatgcaaacagcccaatccaaggggaagaatcagggagaggagacgcaaccccctggaagcataacatataaaactccaagtcggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactggggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaactccaagtcaaagttcaaaccgtgcacttgatctctcaagtcgctcccttggtgctctccaagtgtactttacttcctttcattcctgctgtaacgctttttaataagctttcactcctgctctaactcttgcctcagtctctccctctgccttatgcccctcgtcaaattttttcttctgaggaggcaagaattgaggttgctgcagacctgtatggatttgctgccgcggacacctctgtctctcaaagattccagatttgggtcagtattaaccttttgagccccactggacattctctagggattcttattcagaaagtctgaggtagggctcaagcatctggatttttttttttttttttttttttttttgagatggagtttcactcttgttgcccaggctggagtgtagtggtgcaaacttggctcactgcaacctctgcctcccatgttcaagcgattctcctgctccagcctcccgagtagctgggattacaggcacccaccaccatgcccggctaatttttcgtatttttagtacagatggggtttcaccatgttggccaagcttgtctcaaactcctgacctcaggtgatcgacctgcctcggcctcccaaaatgctggaattacaggcgtgatccacccagtgagcatctggatttttaaaaagtatcatcggccgggtgcagtggctcacgcctgtaatcccagcactttgggaggccaaggcaggtggatcacaaagtcaggagatcgagaccatcctggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggacaacagagcaagactccatctcaaaaaacaaaaaaacaaaaaaacaaaaaaaagtatcttcggccattctgatacacagccacctccacctatgagcctcttctctggaggaattgagagctttgttaccagcggcgttcacatagaggctgggtgctatttgagtctcagtctcccatttataatatgaatgtctcaggctttccttaaagggttttctagggctagcatttcaaattgtgatcgttctaaaatttattcatttgaagtttcctgggtgccttttgtgtattgggtaccgaaaaatttttttaaaacttcttgataaacaaggcagattgtccatgccgatttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcactcggagcctctgtgggggcactgaagggaagtgaagacatttgccccaaagacccctggtggctcagcatggaggacccagcaaagacagggtgagggtgggaatgaaaacagagttttggtggcaggcctttagcctcatgccctttattcacttcttgatgggaaccagaagatggggttcattctcacaatcaatggaaccacagtcattccaggcttggacataccagatacagcagcaaaacaggaggccaaaaacatgaaaataaatctcagagccctcagtaatcagcagtgaatcttttcccagaataggcatctcccattctttggaggagaatccaaacctccaaagagaaaaggcattcacacactgacttgtggggcctcccaatacaaatcctgctcacgctgtcatcactcttgagtgaagccttgtccctcacccacagcttttgctcaccttctttttaaatatgaatgggagaaccacacttttgaaaaagtgtctaacacaaaggagaaaggcaaaaagaaaccaacagaaagataaagcaatctggagcaaagagacaaaaatgtagcagcagaacaaatgcagggggcaatacaccctatcagtaataccctctaaaatatagttgtaaatattatatctaaaaaacaagaacaggactccatgtaaaatgaacggggacagggggaaagcccttagaaattaaaaatatgataaaataataaaaatacagtggacaagttggaagatggatttgagaaaatgttccataaagaacaaaatgataaagagatgaaggaaaggacagaaaatactaaaatcaaacttagaagagcagcctattatctgactgcaaggagtttcagagaaaggagcaagaatagaaaaatgggaggttaggagaaaattatcaaagaagtaacataatgatctagaatgaaaggaaatgagtattgagaattctgcacaactgaagagaaagattctcacctatggaagtaatcatacaatttcaaaactagggataaataagaagattctaaaagttaacacagaaacaacagttcacatataagtgatcaaaaataagaaaggcatcagatttctcatcagcaatgtcagatgctacaggacactgaagcaatgccttcaaaattctgaggaaaattatattcatacaagagttctatatctagcctaactatctactgggtataagtatagaataaagacatttttagacatggaaagtctcaaaagctttgtcttcattgcatgttttcttcttaagaaagtactgcaggaaatgatttagcaaaacaagaaaataaaccaagaaaaaaaggatgagttcatgtactttgcagggacatggatgaatctggaaactatcatcctcagcaaactaacaaaggaacagaaaaccaaacaccgcatgtcctcaactcataagtgggagttgaacaatgagaacacatggacacagggaggggaacatcacacaatggggcctgttggaggtgaggcctaagggagaaataacattaggagaaatacctaatgtagatcacgggttgataggtgcaacaaaccactatggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatcagcttggccaatctctttagtgagatttaggccaatctctactaaaaaaaaaaaaaaaaatacaaaaattagccaggcgtggtggcgggggcatgtaatcccagctactctgatggctaaggcaggagaatcacctgaacctgggaggcagaggttgcagtgagctgagattgtgccactgcactgcactctagcctcggagatacacgaaactctgtctcaaaaaaaaaaaaaaagaatactgaggcctcaatcatcagattgatgtctcaatcttagacatcaatggataatatctaaagaaaatgaatttaaaagttctatcatcaattattttaaaatatggtggaattatcaaataacaggtaaaagagttgtaagagattgcctctggagagcagacagggagcttgagggggtgggacgatggacctctgtgtgtcactataagccttttagcagtattgaattttttcaatcatttgcttgcattgttttgactaaaataatttaaaatttaagacaaagattagttgaaatatgaatacttttcctttggggttccctttgtggagtttcaagtgcccctttgagatttgtttttggtagtgaatccctggtctacactctcaggctccatttgctgtgactgagctgcacaaccagactgtatcctgggcctaagaaacgtggatgttctggctttcggggaggggctgagtcacattcagggtccgacttgactgctagatgaatttggtggtaggcagggagataatttatttccaagcattgtcccacttcaacaccacgcccttctgggcaggaaccagggctaactgggttatattctcccccagtgtttaaagcatggaaaggaatcattatcagtgggcattacttggaaaagccgcaagtcaagaagttatacaggagaggagccttattgttccaaatattagaatttgaaatctgccagaagcaacatctgtctcatccagttattgaagtgcagcatttgaatttacatctctccagggccttgagcctacccaagtcactcaggctccgctaaaactgcacagactggcactaaagatgcaaaataggcctttctgcctggaaaataagttccccttcaccagccccaggtatcaccctctatacaagtaagttaatacaaaatgctgcctaactctccccatcaaatacctaagttggtggacaatattaatgatgcctactctatgctgggcagtgccagggaagaaaggggaatatgaacaggagtggcccagccccttaagggtttacagtgaaggtgaagtcagagggaagcaagaagacacagctcctccccatgtacccctatctgatcaaaggcacccacagcatgtgaaaattcaacagaggaagagaaagcttttgtcaggagccaaagctcacgtggcattcagcatctcttctcatttccattttcagaagggctgtgaaaatgctatttcttttttgttgttgttgtttgaattaggcttttcttgaaggctgagtgacatggattgagaggggtgatgagagaggtgattccaggcccagggagtggcatgaggattatgggatgatagtcagcagaagggaaatgggggcagttgaatggcactagaggatagaatgggttaaaattggagactgaacccaaattcgggagccttcaaggctagactgagggattagggcttcatttggtggacacaggatctgttgtttgactggatggctcccatttgcagaaacggtacaaagtcctttacatatagtgtctcttttaatcattgcattaactccatggagtatgtattaatattattgtcctcattttacagaatcagaaactaagcctcagagaagtgaagtaacttgttcaagtcatacagctagaaagcagcagaggtagaattcaaacctttaacttcctaactcccaagtcagagcaatttccgtcatgctatgccccttcccacagagaggcttggagtgacccagccaaagcacagtgctagaaagatgtttgggcagcatatagccaagacaatcctaagcaaaaataacaaagctggaggctggcttcaaactatactacaaggctacagtaaccaaaacagcatggtactgatacaaaaacagacatatagaccaatgaacagaatagagaactcagaaataagactgaacacctacaaccatctgatcttcaacaaacctgacaaaagcaatggggaaaggattctgtatttaataaattgtgctgggagaactggttagccatagacagaaaatggaaactggaccccttccttacaccttatacaaaaattaactcaagatggattaaatgtaaaacccaaacctaaatgtaaaacccaaaactataaaaaccctagaagaaaatctagggaataccattcaggacataggcatgggcaaagatttcatgacaaaaacatcaaaagcaaaaattgacaaatggaatctaactaaactaaagagcttctgcgcagaaacaaaaccaaacaaaaaactatcatcagagaaaacagacagcctacagaatggaagaaaatttttacaatctatccatctgacagaggtctaatatccagagtctagaaggaacttaaacaaatttataaaaatcaaacaaacaaacaacatcattaaaaagtgggcaaaggacatgaacagacacttctcgaaagaagacattcatgtggtcaagaaacatatgaaaaaaagctcaacatcactgatcattagagaaatgcaaatcaaaaccacagtgagataccaatctcatgccagtcagaatggagattattaaaaagtcaagaaacaacagatgctgatggggctgtggagagatacgaatgcttttacactgttagtgggagtgtaaattagttgaaccattgtggaagacagtgtggcaattcctcaaagacctagaaccagaaataccatttgacccagcaatcccattactgggtatatacccaaatgaatataaatcattctattataaagatgcatgcatgtgtaagttcattacaacactattcacaatagcaaagacatggaattaaccgaaatgcctgtcagtgataaactggataaagaaaatgtggtacatatatactatggaatactatgcagccataaaaaagaacaaaatcatatcctttgcagggacatggatggagctggaagccattatcctcagcaaactaacacagaaacagaaaaccaaacactgcatgttctcacttataagtgggagctgaagaatgagaacacacggacacagtgaggggaacaacacacactggggcctatcgggggacctgggcagggggagggacagtaaacaacctaatgcatgctgggcttactacttatgcaatgggtcaataggtgcagcaaaccaccatgacacatgtttacccgtgtaacaaacctgcacaccctgcgcatataccccagaacttaaaataaaacttaaaaaaggaagatgtttgggcaggtgtgactgaaactgcagatgtgtgcagaggcagggagtggatgagtgtggccccagctgaccatccacctcatcacttgttgtcacctctggcactcttattaaatcactctcagtttctaaatgtgcagagctccctcttgttctttttttgtttttgcactggctattccctgtgcctggaatggtgttttccttcccttcatttggctaattgtcctccagaccccaaggtggatgccaccttctccagaaagctttccgtggccctctctcgctgcattagggccattaggaaagaggtctaacagacttccacagtttaacatggctgggaagatctcacaatcatggccaaaggcaaagaaggagcaaagtcacatgttgcaatggtggcaggcaagagagagcatgtacaggggagctcccatttctaaaaccatcagatctcatgaggcttattcactaccatgagaacagtataggggaaagcaccaccatgatccaattatctccaactggccctgcccttgacacgtggggattattacaatgcaaggtgagatttgggtagggataaagccaagccatttcaggaccattaaaaaattcactaatcagggtcttcttcataattccaaggtcaagggaaatgtgtaccttccctccacattgagggggtagctcaatgctacagaccccacggtcagctctacgttgatacaaagatgagaacttggactttggtcccagggaaaggtggacacgcggatgaccacctgaccactatgtagaacaaagcaagtctgtgagagaggagtactgtttgtgggaggcagagatggggacagctgattctagtggctggcaggagagagggcctctcaagaggcccctgctcgctgggttttgcaggatgacaacagtcagggaatgtagaaaaaggaggttgggaggaagaaacagcaaaggcagaggctgggaggtgggacccgcattgtgggatcctggaatgggatgtggagtcacagtgggatcctctaccttttgtgtgtgcaagaatcacatccagcgagtctgataaacaatgaagattcttggggaaccacctgcttcaagattcagatcttgaggtctggaatggggctgagaagtctcatttaacaaacacccaacacgcttgttaattccaatgtgctgtctattgggcttagctgctctgtgaggtggaggggtggatgggtggagataaagagcctggagccaggtcatacggacctggcacgtcaccatcctgggaggtctaaaccctgcagagggaaatcagggagtcaacactgaatatcgagggggagacattcgagaattcttacaaaagagttgctgaatgtttattaaagccaattttgtatgcacccgggtatacaaaagagtctgaaattatacatgtcgtgtaggtttcagaatcttggttcaacagggattggccagggcagggatgagaatttgcatttctaacaagtgccttcccagctggtgccagttctgctggtcctgggaacacgttttgagaactctggttgttatttaaaggagttcaggcattaacctgtgagggactctgaagtggcaggaagaatgcaaaggtgacaacctctaaacttcttttctcctatttcccttcaaaggaaattcatcatgcaatggccttcaacccatctgaacattttctctggctacagaaaatgcctgggtcgtgccccgaaatgaatcttcttttcaaagagaaacggtaggatttacaggtcagtggaggataaggacgatgttgctgggtggctggggcttaaaatcactttaaaatagatgagtacatttcttctaatattcttgataaaaatcaaaagttcttctcttcctggacttgaatgaagtccagagagttctaagtcaaaaagttcacagaaaacaagtgctttcaaacacttagggtctggatgagaaaaatatgaggctgcaaaggactgttttgctcaaattcctataccagactctaacctttggggacagccctcttgcctctccatcaacaagtcaggacgttggtcctaccacagagaaattatgggctgcaaaaccaggaagctcaagtcccactgcctccctgctgcagacattcggagtaattatcaccccgctctgagactgagcttttcatctgtaaaatagaaatttcataacatcttttctaagtactgccacatgacataaatgacgcgatgactgacatcaatttggcaccagttccaggcactgttccaagtgctgaacatgtattctctttcttaagccttacaaaatccccacgaaagaggtcccattattaatgctattgtataggtaacaaattaggcttggagaggttagcaacttgcccaaagtcccacagcaagtgtgtgtgtgagaggtgtggggagctgtgatgcagatccaggcagtcgggcacgagggcccaggtgcccactacacagccctgcagaggctgttttgggcctttccctttgaagctcatttctctctgatagaatcacacattatcacccttttttaatctcatgggaaatttttctgtattttacggattaaccataattattgtgatataataaaaatcacttgtaattttggatctgttttttaccattataaaatggtaagtgctaagaaagagctgccatccttaagcaaacatggaatattaacaaaagatgatcacaaactgaccacagaataaactatcatatgttccccaaagaagaaacttatggatgacctttctttatgtaataaaacaaaactggtaatgaatgaggataacaaaatcccatctacaaaatcccaaaatcccaattgaaaacattgttctaaataattaatctgtattcatttgtgtgttgtttatggtatctgtttttacatttgattcttaaaatcatttcagttattttttaaatggtgtaaatttatatagttgtatgctaacaaatttgaaagtttcgatgacataagtgactttattgaaaagacagaaattaatgacatcaactcaaaagaaaataaaaatagatttttacgaaagtagttaaaagatattcaaagcatttttttccccaaaagactacagggtgagatggttttactagtgaggtcttttaatactttgattatcaactaacgaaatgtgagaaattacatttctgtctctgctgtggttacttgttacagcatcaacaggaaacaaatatacttataagaaattctcatctattatttttgcctatcaaataccaaagcctcatttaaatgcttgtggatgacatgggcagagtgagactaatgcccttgtgccctgccagcgggaatggaaattgaagcagactatccgaaaaaaaattgctcatatgtacgaaagccttaaaaaaatttacactctttaacctgttatttctatttctgaaacactaaactacatgaataattacagatttgaataatgattaatgtagaagattattcatctgaagtttacaaatcacactttttcagtaataaacacactggaggctgggtgaagtggctcacatctgtaatcccagcactctgatgggccaaggtgggtggatcacctgaggtcaggagttcgagaccagcctggccaacatggtgaaactccatctctaccaaaaatacaaaaattagccaggtgtggtggtggatgcctgtagtcccagctactcgagcggctgaggcaggagaattgctagaacctgggaggcgggggttgagagccaaggtcgagccctgcactccagccttggcgatggagtaagactgtgtcgctaaataaacaaacaaacactggaaacaatccaaatgtccaggaaataaaagaaaaatgaaacaaattataactcataaatagaaactagtacaattattaaaacatggtgtaatgtaagcattgctttagtcttttttcctacccttttcccattttttcctaagctattcattaaaccaaacatttcctctgttgatttttgaggtttccttttgcacacattaaaatcatacatagaaatgaattttctgcttctggccatcccttagtgcctttgatctttccattcttgtgcccatgctgcattgttttaattgttgtcactttattacatgtttaatgtactcactagcgtccattttcaaaactatgtcagaaacatacacttgcttattctcttgtgggaactttagaactctttcctcattttccatcacaaacagaaatgtcattgaacttttgattgaaattgtattgaatgaatacattagtttgaatacaattgagattgttttttaaaattcattattatcattataaaattagtaaaactatcacagcaaataattttaatgacttgttcacaacatcaggttgcaaaataatcagaatacaaaaagttataaatggaatgaaccaaattatgtgcttcttaaattttataaaagactaaatatcattgggcctcttaatacacactaaaattatgttatgttgaaacatgtttataaaactaaaaaaggatttcatctataaaatatttgtatgtgatagtttaaaatttctttctagattttcactaaaaattaagattaataagagttgagcattctgatttctgcatataattctttatgtaaaatgtaccaaaaaagtaagaactgtttttaattaaaaaattataagacaaaatatgtacttcatttaaaaataatttttttaaattaaaaggttattaaaagttgtgtcaaaatatggatttagaaagaaaatataaacaaaaagaatccagtaaatagaaagagatataaagaaagttatgggaataaagatatatttctggtaagaaagatttaagaaaagaaaataactttacattaaaaaatcttgcctggtaaatgttttttcctaaaataaagtgactggttatttaaaaataagaaagtatagaacaaaacaaaagttataagcatgccatgaaagttacgaaagtctgtgtaagttgtaaaaggtctgaaaatgataaatttacaaaagaaattttgtatgtgatcaagttgactatatttaaaagggaattatttataagcctttctaaggtttgagttttgatattaaaaatacaccaatacaaaactaaaaatttggtcccttatgttaaagcaacaaagttttcttgaagtaatgatctgcttttagtaaaatttacaagaagttctgatttttaattgtaaaaattttcagccactttctaaactgtagcttatttttttgtttgttttatagtctccatttaatttaactagtttttagtttaaaatgctatcttcttcttaaaaatggtatcttcatttctcaaggtggagttttcgtcttgaagcttctcagagtcctatctcagaagttcaattttaatgtgtctcacagcatagcatgtgcagttcatactacattgccttctgttctttcactttctttccttgagaaggtacatctttttgcttggctggaatgttgactttctccttcaacttctttgttagctcctataacttcttcctctcattctaacagctattgaggcctgacactaaaaatgtttgtctcaaagacctagaaaagcaatgtttctttttttccagtataacttgattctgtacttagcttttcttcatgtgtctacattgttccatgtaaccagggaatttctcatgcttttactaagagccatatatccccctgcttaaagtaatacttttcttgtttatgttccacagtgtacagtcatagccttggatatacattctgaatacatacaagtactttttcatcaggttgtctaaacaggcttcccatgaggtgaaccaatcacatagaaggaggtttttcattgcctttttagtaactggcctaagaaacaaatattttatattttatcaagataatttcctgtgttgcctttactaaatttttttattacttttaaaaaatggagactttaagggttaaagtttttttaatatctatataactttctgtattgcttttaagatctataattatcactctaattaaataaatgactatcacacagtgccctgtgatactgttttgatcaggtattttaaaacttttggcatctttgatggacttccccagcatcaaaatgctaaattaaatctttttgacataaacttaactttgagattttccagtcaggcccctagaaagcctcaaaggacttctctctcatcttgtagagatattaaataattaggcttatttggtaaattatatgggaaatatcaaatgctaagtgatactagatcttctttcagttacatttatggatatgttattggtatatatgttctaaaatggtaataaaactcttaaaatcttctatgttatcagtcataattttggttattatattgtaggccacaaaataactaaatttccttgcaaatttctggttatggggaacttttatcctattttcaactatggtagttttaaatttttgtcatttacagttattttaaatttttctctaaagttatctgcaattagattcattacaaagactttgacaaatactcttaaatacaagtttcaaaaaactttaagatcaatgtggtttttttcccccaagatggcagattagaggcattgttagcatgcctcttgtattagtcccttttgatgctgctgataaagacatacctgagactgggtaatttataaagaaaaagaggtttaatagactcacagttccccatggctggggaggcttcacaatcatggcagaagatgaaggcatgtcttacatggcggcaggcaagagacagcatgtgcaggggaactctcctttgtaaaaccatcagatctcataagacttattcactatcatgagaacagtatgggaaaaatccacccccatgattcaattatttgccactgggttcttcccacaacacatgggaattatgggagctacaattcaagatgagatctgggtggagatgaagccaaaccatatcacctctcatacttggaaagacaaaatagtgtgtagagactcacgctataattttttttccaagaaacaccacaggcatttaaccagaaaactgaaagaaaccacagactctttgaaagaagtggtggcagcagcctacaccataagccaggtggaaaactgtgagtcctcagagtgtggcagtgggagagactgcctctgtgacacacactcccgctagggaacctgataatataggccatgggggatggccttggccccacccagcactggagctgagtggtggggaatgttgagaaggagcagcatcggacatgctttgcgtgcactcctagactccagtggggatggagagaagacattcctgactctacttcacagggagccttgcagaagtcagccagccaactcgggtggcagtcacaggttgagagaaggtctcaactgtgattcacgacataatcttgagtggggatgagctcccttggccagaactaaggggcaagtgggggtactgtagtcacaagtacagaagctgggcatccctgctttggggtggaccaggaggggcacagcctgaaaaccacagtttctgtctgggtggggaaagcttatagcctgtggcagttttgagttctcagtgcaaggttcctggaacccagctagctgggttaaacaaacaaaaagagtttgtgctgttgctaatactacatgctatacttggataaattcccctagaagagttaagactcaaagacacaaaattaaaaaaaaaaatgcaggttacaatgagggaagaaagagacctctcatattgttttatactcagtacctgttttaagaaaaaaacaaggaagtgaaaccaaaggcaggcagcccagcgccaggcgccagacccaaaaccggacccaaaaccaggcctgggcctgcctggcctaaacctagtagttaaaattccacccctgacctagcaactgatgttatctatagattccagacattatatagaaggacattgtgaaacctcccattctgttctgtttcactctgaccaccggtacatgcagcccccgtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcattgtgtgagaggttttgtctgtggctcatcctgctacaacaacaagtttcacctaatttgtcatgatcatttaattaatttaatttatttaatttatttaattggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaacttaaacttaacacttgattttaggtagatgtagcctgagaaccactctctccaaacccctcttgttgctcaaatgtagctaaaagagtttagacactaactccaattacaccttccaatgtaggaccaaccaacaacgtgagacaggttgatcccagctgcctcacctagggataatcaaaacctaactacaaaatggttaaccagtgatttttttaaaaaatcttgatcaaaaaaggaaatgtgaaagttgtcagaataaaaataaagtcacctgtgttaaaaagcaaaaataaaagcaaacccctgaaaaataaagctaaggaaggtcatgaaaggaagattctcatatacagatgcctgctggcaaaaactattgcaaaagactgcaaaaaccttgcacaaaggccactacaaccttacacgagaaaatactgctgcgagaacacctgcctagcaactgcctgtccaaccttggactgatgccacccttgttactgatccttctattcaaagataactatctcaaaaacaattacataattcgtctcattttttctttaaaatcctttgtcttctttcacctccctgaatatgcacatggtttactatggcacacctatgccaattgcaatgcccattcctgaataaacattgttttctttcagaaagtctccctgtttgttatttagattgaaaaaatttgcaaccattagtatatttctttccttgagaggaaagaaaagtgggagctcaaagttaatcattcttatctgacataaatgttcttctgagcatataaaatcgttcctttacggcctcacatcattcctaatctctcttctcatacttttgcctataattttcatctaagtctatttcttctttatctttgcaagagaaatagctaattgatttgttttaaaaaaaatatatcatttggagtcacataaatgttcagccatgacaattgttttatgatgtatctttgattaaattcatggaaccagcattaattcctacatttatttccctttcttgccttctagcagcctactctaaaagccaccttcgtctaccacaggctcagccataaagcaagtctcagtagattcaaaagaattaaactcataccaaccatactctcagaccacagtggactaaaattagaaatcaacaccaagaagatctctcaaaaccacacaattacatggaaattaaatgacctgctcctgaatgacttttgggtaaacaatgaaattaaggcagagatcacaaattatttgaaataagtgaaaacagagacataacataccaaaatctctgagatgcagcaaaagcagtggtaagaagaatgtttagagtgctaaatgcctacctcaaaaagttagaaagatctcatattaataatcttatcaccactcctagaggaagtagaaaaacaagatcaaaccaactccaaagttagcaaaagaaaagaaacagctataaaatcagaacagaacagaacaaaattgagatccaaaatccatacaaagaatcaatgaaaccaaaagttcattatttgaaaggataaatgagattaatagaccactagctagattaaaaaagaaagagagacgatccaaataagcacaatcagaaatgatgaaggtgacattataactgattccacagaaatataaaatatcttcagagactattatgaacacttctaggcacacaaactagaaaatctagaggaaatgaataagttcctggaaactcacaatttcccaagattcaattaggaagaaactgaaaccctgaacagaacaatatcaagatctgaaattgaaggagtaataaaaaacctaccaaccaataaaagccctgaaaagatggattcacagccaaattctattagatgtacaaagaagagctggtaccaatcctgctgaaactattccaaaaaattgaggagggactcctctctaatttgttctttgaaatcagcataacaccaataccaaaacctggcaaagatacaataaaaagaaaatgtggcacatatacaccatggaatactatgcagccatgaaaaatgaagagttcatgtcctttgtagggacatggatgaagctggaagccatcattctcagcaaactatcgcaaggacaaaaaaccaaacaccgcatgttctcactcataggtgggaattgaacaatgagaacacatggacacaggaaggggaacatcacacactggggcctgttgtggggtggggggaggggggagggatagcattaggaggtatacttaatgttaaatgacaagttaatgggtgcaacacaccaatatggcacatgtatacatatgtaactaacctgcacgttgtgcacatgtaccctaaaacttaaagtattaaaaaaaaaaaaaacagaaaactagaaaccaatatccctgatgaacatagatgaaaaaatcctttacaaattaccagcaaaccgaatccagtagtatatcaaaagtcaattcaccatgatcaagtaggcttccttcctgggatgcaaggttagtttaacatatgcaaatcaatataggtgattcaccacaatagatgcagaaaaatgttttgataaaatccaacaagccttaatgataaaacctctcaagaaactaagcattaaacaatcatacctcaaaataatgagagccaactatgacaaacccacagccaacatcatactgaacaggcaaaagctgaaagcattcctcttgagaactgaaacaagacaaggtgcccactctcaccactcctattcagcatagcaataaagttctagccagagcaatcaggcaagagaaagaaataaaaggtattcaaataggaaaagaagtcaaactatctctcttcactgatgatctagaaaagactccaccaaaagtctcctggaactgacaggggatttcaggaaagtttcaggatacaaaatcagtgtacaaaaatcagtagtatttctatacaccaataatgttcaagctgagagccaaagcaagaatgcaatcccatttataatagctgccaaaaaaaaaaactaggaaataattaaccaaggaggtgaaagatttaaataaagaaaactacaaaacattactgaaagaaatcacagatgacacaaatggaaaaacattctatgttcatggattagaacaatcaatatcattaaaatagcaatactgcccaaagcaatctacagattcaacactatttctatcaagctaccaatgtcattttccaccaaactagaaaaaaaaattctaaaattcatataaaaccaaaaaagagcccaaatagcccaagccatcctaagcaaaaagaacaaaagccagaggcatcatattacctgacctcaagccatactgtaaacctacagtaaccaaaacagtatggtactggtacaaaaacagacacatagacaaatgaaacagaatggagaacacagaagtaaagctgtacacctacagccatctgatctttgacaaagttgacagaaataagcaatggggaaaggacttcctattcaataaatggtgctgggatagttggtttgccatatgcagaagaatgtaactggacccctacattttaccatatacaaaaattaactcaagatggattaaagatttaaatgaaagacctcaaactataagaatcctacgagaaaacctaggaaatatcattctggacattggccttgggaaagaaaattgcaaaagaaattgtaacaaaaacaaaaattgacaagtggaatctaattaaactgaagagcttctgtagagctcttcaattcaagcaactatcaatggagtaaacagacaacctatggaatgggacaaaataattgtaaactatcatctgacaaagggctaaaatccataatctataaggaacttaaacaattgaacaagcaaaaaacaaataaccccattaaaaaatgggaaaaggacatgaacagacacttctcaaaagaagacatacaagtggccaacaaacatattaaaaaatgctcaacatcactaatcatcagagagacgccaatccaaaccacaatgagataccatctcacaccagtcagaagggctgtgattaaaaagtcagaaaacaacagatgctaatgaggctgcagagaaaagggaacacttatgcactgttggtgggaatgtaaattagttcagccactatggaaagcagtatggaaatttctcaaagaacttagaactaccatttgacccagcaatcccattattgggtatatatccaaagaaaataaattattctaccaaaaagagtgatgcactcatatgttcatggcaccactattcacaatagcaaagacatgaaattaacttaagtgtccatcaatggtggactggataaagaaaatgtgatacacatacaccgtagaatactatgcagccatgagaagaagcaaaatcatgttgttcgcagcaacatagatggagctggaggccattatcctaagtgaaataacacaggaacagaaaaccaaacactgcatgttctcacttataagtgggaattaaacaatgggttctcatggacataaagatggcaacactagacactggagacagtgggatagatggaggggagggatagaggggagaaaagttgaaaaactattgggtagtatgttcagtacttgtgtgatgggataaattataccccaaacttgagtatctctcaatatacccaggaaataagtacgcacacgtaccctcttaatttaaaataaaagttgaagtcataaaataaataaatagctaccttcttgctaaccctccttcaccctctgtgtttcaaagcaattgccttcattgaagcccagtttttctctctcttttttcaaagcttcgttgtctcagtctttgaaggtaaatgggaaatatgattaaaatagtgaaaatgaaattctgacacttagtgaaataactgtgaatttcacttggctggaacactgcaaatccccagagacatgaataaaaatttcccatttgatgttctttcctggaccagaagccctagatccacattcccagagcatacatttgaaaacagaaggatatttacagggttcctcacccatcttcctggccagggccaagactgtctggaaactcccatctgatgggaagagacagcctataggaaccaatggtacaccttttggctagctcaaagccagaaggtgggcatgggcagctgtgccccttggctggcatcatgttcatgagccctgttcctgggagagagtgtcccagcctcagaatctaggtacccaggtcctcgaatcagctcttccttccagttgctctgagacatgcacagttcacatcagtgaacttgtcaccttttcccctgcagagctactccttctctttcatagctccctgtcttagcatctggtaccaccattctatctggctgatgtgccagacgcctgagagttatttttgactcctcctctctgggacaccacatcccatcaccactaacctcactcaacctcatctgcctctctccatccacactgccattactctgacccaactcataactggaccagtcaaccccttcagtcctggctgggatccaatcctttctccatgctgcaggccaaaagccttcttgaagcactcatcatgtcctcaatgatgtcccattgctttggggtacaaataagccttcacagttacacagtccccatcaaggtgtgtgaaaggtggccctaaggctagacccagcccacaggtgggacgttttttgttttttaaaggtcagtttccaatatttacaaattatgaaatatgacaaatctggatttgtaatgtctcttgaaaatcagaaaatctgtcatctctaggccagtgtctgtgatggaaacagtaggagatgcccttgtccctcaagcagccacaggtcctgggaacctctcaccttgcccatccttccctgtgctcatttacagcataggtgtggccctctctgctgcctgccttgccagcggtctctccctctccctctccccctccccctccccctccccctgctcctgacacctgagtttttctgcctctgaacaaatgccagggccttcccccatactcttacctctggctagaactccccgcccccattgcctctctcttcctacagacccgcccagataaatcctactcatcctcaagccatgagtttagatgtcactgctgcaggaaaaccacccccgatgccctaccagaggtcagtgcctattttcctattacctgtggccattggtcaattgccctcctgtgacctccgaagggcagggctagcctgatgatctcaccactctaccaccagcagccaacccaatacctggcacaatacctagcacacaatagaagctttctacacatttgttgaatgactggataaacttgacgcctctgggttagtgtgcacgcaagtaagatgccatcgactggcgggacaagatgcggaagcaaacggaaatcagtgtgggagaggcacaggtgcacggtgtcctaggatatgctgaacagtcactatttgccagcgatgttttcccagaggaagtcaagcttgagtggggcttgggaatttgggacttgcaaccattcctgttactgaagaggacactgggtcagagaggtgagtcgaccttcccaaggtcacaaagtccttgcagtctgagtaagaaagacgtgggctgtacctgatgtgctcaaagctgtagctccagaatcaactcaatgttttaacaaatgtggtgaatgaataaataaagggtgaagacagaggttgaagacagaccttacggactcaagcaggagaaagaacttgatattgatttataaacaaagtggaatttggaaatgatccccaaagagaaaagtttagctctactgaggtaaatatttatttactttttttactcctaaaggacaatagcactcttcattgacttttaaatgtatttttgtttagggagctgaggctgttatcttgtttttattatcaacatgtggtggttattttgagaattttaaaatatctttagaaacaaaaagcaaaagagtctctttagtttggaacctcacttaggttgagagactgtttctaacacactcgcaattaattatagaaatcgtcatgcatatgacaaccacaaatgtaaaatgtgagttgtttctgtttttgcaaaagaagaaactaaagtcatagccgtaataacccagaatggtcataataaaagatcagaagcagatgcctctgaggtgacctcgattggctgaaatataaaaagtcacttataatatcacagaaaagtacacttaagaatggtcaaaatggtaaactttatgtggattttaccacaataaaaaatgttcaaaacatttaaaatttgctttaaaaatggaatacagtgattcctccacttataaaaccttccactgaatgagaaaggagctggccctagagtcagtgaggctcagtagctgggacagaaaggaccctgtgggcagaattagccccttctctccagagcgcccacattcccagaaacaccagtgtgatccatccttggatgtgtaagacacaacccatacgtggctttgaaagcacacagacccgggttctggtttcagcaccaatatgcccttgtttgtgagagctctgtcccttacctctctctgcttgcgtccaaggctgcatatctgagctactcacaaagtagctgttaggatttgagcagcataacaaatgagtcttttacataactgctctaggacgtgcgaatttgttatgtttgccccctgctgctagaattcagctccacagggagctgtttgtctgttgtgcactgttcgtgcctagaacagtctggcatgaagtgggcattcgaccatcattagtggtttaatctctgcctaccctcctgccctgcctgtgtgagtgggaaggcagcgcccctgcatccctgggaggcatcccctgggaggaatcctagcaagtccagtggcctctttatccccatgtctaccacctcagtcgcagctgcatccttcccttaccatgtgtaccaatagcagcagccctctgcctctctcctccccacccttcccactctagtctacacccaccgcctccaccccagagccaccttctaacactgatctggccatgtcaccctccagctccagtgccatccagggcttcctattcccccagggtgaagtctgtggtggctcagtgaacagacgcttcatctctcaccctccccatgcctgctttctcctcagccccacagccatctgagttctttcccagggctgtgccccatcttgagccttttctttactgatttcctttctctggtatatcctctgtcccaatccccatcatcacctgcctaactcctgcttacccttcaggagtccatttagaggccacctcttctaaaaagccttccttgagtttaccccaccccattcgacctgagtgaaatgtttcttttctccctgctaaggccacacagcaagtaaatcatcgaactgggattcaaattcaggcccacctgctcccaaaacagcaagccaaaaccggaagactctacttacttatctattcaggaaaaaagagactaaagaatgaggtagagctaagctaacgtcttgaaaagatgcccaaaatatattaaatgaaaacaccaggttgtagaacaatgtgtatggcataattccatcaaagccacaataaactatatatgtttatataggtttttaaagcacagaagatgcctaaacaaacacaaattgagctattaatgataattactgggtgggtggacttaaacattctataaggtttcaatttgttatgtattctttatgtacttaaaaaaaataaactcaaaggaactccacaacttttctccaataataagtaagaggcttgaataccagaaattgcaaaatacagggaccagcttttggagaaaaggctccttcctgcagtggtaacatgagatgagagcagatgcggttgaccagggagccacactcacctttcccagcagctcgggcaggcccagaagctgcccagtgaacacgccaatgcagataaagatggcagtcacctgccccagagagccacggatctccttgggtgagatctcactaaggtacatggggagcacactgagggcgacgcctgtagagagaaagcatagcagcagttagagaggtgtcttcccgggggagctgcactctggttacaatgcctctcttggctctgctttgccctggacattaaatagcactgtagccacggcatttttcccagcacttagcacaaattgccaaagctttcccatgaactttataatttaatcctaaagtatgactggaggtgcatttcagaggacaggacacagctgatggtgttggtggaggtgatggtattgatggtgataatgacggtgatggtgataacggtggtcgtgatggtagtgatggtggtggtgatagtgatggtcatgatggtgatgatgatggtagtagtgatggtagtaatggtgatggtggtagtggtagtgatggtaatgatggcgatggtgacggtgatgatggtggtggtaatggtagtgatggtggtggtggtagtgatggtcatgatggtgatgatgatgatggtggtggtgatgactgtgatgatggttgtggcaatgatgatgatggtgatagtggtggtggtagtagtaatggttatgatagtgatggtggcgatggtggtgatagtgatggtgtggtggtggtggtgatggtgatggtggtgatggtggtcacaatgataatagccaatacacatagtggctaccaagtaacaggaatccttctcatctctttatatgtattaacgttatttacttttaacaatagtcttctgaattaaatatactattaccatttctcttctaaagattagtaaactgaggcacagaaaagttgagtaacttgcctaaatcaccaagtaatgtccagagatgtttaaaaaaattattttgcccaatagagccccagtgggtctctgatcttagaacttgcacttttcccaccagctaacattgcctcttgtcataaattatgggactccgttatggcagatgctattatactcattttataaaaatataatagtttttttctctaaaccttctagatgaagaacactccaggaagatgccctgttgtcctattatggtttcaaatactccgggagaacctggctggattagcaagtcttagagccttctatcatctcaaaatccttcaggtttatcatttggctttaaattcttttttttttttttccaagatggggtttcactcttgttgcccaggctggagcacaatggcttgatctcggctcaccacaacttccacctcccgggttcaagtgattctcctgcctcagcctcctgagtagctgggattataggcatgcgccaccacgcccagctaatttttgtatttttagtagagacgggtttctccatgttggtcagctggtctcgaactcccgacctcagatgatccgcctgccttggcctcccaaagtgttaggattacaggcgtgagccactgcgcccggaccggctttaaattctttattacaaacagatcggccagttcaggtaatagcagcaatattcctttctttctgaccaattgtctcaccttaagtgccctcgagttcttctctctgctttgagagggttggtgagaatacatgacatgaagtctccaagtcctggcgtgactccaacaggccacgtgccacaagtcggaaagaccgaagttttttctttccttcttgttcttctttctttcctgcttctttttgaaagctcataggaaaaagggtctaaaagacatttgttctatctctgtggttttgtaaaaggtccatcttggaatgcagcttatttttagttaaggaaattcagagatcaattagttatatgttcgaagggtcaactccccagattagtcaaagcaacaagaaaggggataatggataaaatataaaactgccaaacagagaatctcagttgcctccactaggaaaggacttcccagaagatccactgcaacctcatccaggctttctccaaagcaggcagggcctctgaaacccaaatcctagatctgtactttattaattaagaacacaaataacaacaatgacaataataccatcagcattcctggagtggggcactaagtgcctggaactacactaagtacttcaatacgtagaacatcgtttattttatttatttatttatgtatttacttttgagatcgagttttgctaacgttgcccagacgggagtgcaatgggtgatctcggctcaccgcaacctccatctcctgggttcaagtggttctcccacctcagcctcccgagtagctgggattacaggtatatgccaccatgcccagctaattttgtattttcagtagagacagggtttctccatgttggtcaggctgctctcaaactcctgacctcaggtgatccgcccgcctcggcctcccaaagtgctgggattacaggtgtgagccaccgtgcccggcccatttaattttcacatcacccaacaagggaggccttactgctaagttgccacgccaggtgggaaagaggccaagactgtgaggtcaatggttgctgcagtggtccctgatttgtaccccctccctggatcgacatccttggggagttagtcctctctgacatttattctgcacgtggccatgggacttgcttgggccaaagggacaccagcaaacgtgcatgcaaagtgcttgcacattgtgcacattgggactttctcctttggctgctgttggaagcccaagaactttatgcaaggcagcccaggcccccctggcccagggtgggaagccaagaaatgagctggcccactgacagcccgtgagaccaggccacctgctaacacccaaacacaggcgtgagaccatcccaggtcatccagccactgaccaacctgaagccaccgcagacacatgagaaggcccagcagagattggcagagctggcccagagcagaactgcccagccgacccacagaagtgaaagcacaggaaaatggttactatttgaagccattaagttttgttttgttttttaagagacagggtttcgctctgtagccaaggctaaaatgcagtggtgccatcatggcttaagtttcggggtttttaaatacatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgagaaaacagtctttcattacaggaggagatcaaaaaaaatgaaaagcatgaacacagttggtcagttataaaacattacatagacaccagccattattcttatggataaactctcaatagccatcaatagaaggagtctattcaagtagtatagacaaatgaatagacaaatgattgaggagtcatttcatcttgagtttggactattagagaggcctagattattcccctccagcagggcaacaaaagtaagtgaagcctcctcttctcaaccttacttccaggcccccactctcctgctcacctctccctgagacatttttattgttcatctcactcagctgaacaacctggtaccctcagcttttaagacatcgacaaggaagggaattagcctttaagaagctcatgctaggttccaggcagtacatatgtgtatatgtgtgtgtgtgagagagacagagagagagagagagacagagtgtgtgtttccgttcagccttattatagccttttgaagtaggtattattaccaccattttacaaatgggaaaaccaaggctcagagccattaagtaacttgcagcagaactgagatccaaactcagggatttctaatcctaaggcttgcaatctttccacaaatgcctaaaagtgatactttatggatttgcctatttagaaagagagcagcgtttgtctgacaatatatcttgagtctcctactctcactcccatagccagcatctgtccccttctctgcagctccccacctagcccagtcccttcccctgaacagctggctcctctgattccactcctggcttcccctcatactccattactggaacaaaccagtccatgtcacattcatctcaaccctccctgcatactcggcacaggcacacagtcctcgccgtggcctacaaggtcttatgtgatctggccccagctcctctttggcgtcatcagcacccacacatctccttgctctttcccagacgtgccatgcctccttccgcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactgtctaccttatgtatctgtctgcccactagaatgtaagctccagggacagggtcttgttaatcattgtgtctccatcctatagtgtgccagccctcgcaggtgctctacaaatgcctggcgagtaaatgaaataacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacagccccaaacacttctcacattttgggacacccccaaggagtatgttactgttccctccccgtcatggtgaactctcacctccatctatgcccatgatgaagcgtcccacgatgagcatttcaaaggctcctgcctggagcgagcaggccatcagcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaagactcaggcacagtgcagggagcactggccttgccacctctggctgtgtgactgggttcagccctggggtctactaggtcacttacaaaggcaccatcagccttgacatctatgaattctctgtggtagtattttattgctttaattctaagactatcatttaacatttctgaagtcagtggtcatcttacaattcgtgagtcagggtccaggcaggaaaatggaaaccactctaggtattttaatggagagaatttaacatagggaattggttaagtggatattgaagaaccgagatgtcaaaaaggaagacctctgaagaaggggtgtttcccatgtggtgctgacacctcaggggcatggaggagggccccgaagacctttgagagtgggcactgtccactggactgtttcctctgaggagcaatatgattctggttctggaaatggacaaaagttggaagctggaatcaactgccaatgtcatcactgggactggcaggaaactcagacaaacatgaaaaagctagtcttttctctctcctctagtgcccctattggcaaaggacaaatgggggtgcaggccccagccccagcatcagagagagagagcccagaagggtaagtgtggagctaggagacaacagcttgacaaccagcatagcgttctacaacttttgttggctccttccctccctccctccctttcttccttatttcctttcctttccagtggctcataaaataacaatactcctcagacccaatggcatcttagatttgatgaactacagtactaagtgaatggctggactaatcctctcaaacaagattagggaaatttccatggcaataattattattaacagctctgtgtcaggactgccatcacttttataaacacatgcctaagacctcatggttcaaatacctgacttgtttggaggcctggggacctggattcctgcaccagctctatccttcaggagctaggagactttgaacttcatttctctgtgttttcttttcctcacttttgcaaaatgatcctaaaagcccacatttattgaactcttgctataggatagaccctgctttaagtactttgcattagtagctcatttaatcctcagaatgacccaaagagataggtactcttataatctctattttataaacaagttaactaggttgctggcaagctagaaacttgttttatttttaatttttatttttgagacagagtcttgctctatcacccaggctggagtggattggcacaatctctgctcactgcagtttccacttcccaggttcaagtgattctcctccctcagcttcctgggtagctgggattacaggcatgcaccaccacacccagctaatttttgtatttttagtagagacggggtttcaccatgttggccaggatggtctcaaacttctgacctcaggtgatctgcctgcctcagcctcccaaagtgctgggattacaggcgtgagccactgcgtccggcctagaaacttgttttaggtcatatagtcagtgagtcaaggagttggggaaacatcttagccctttacggcttattttttttcctatagactcaatgagttaacagatattaaattgttttgtaaattgtggttaaaaaattattttgcccaatagagccccagtgggtctctgatcttagaacttgcgctcttcccaccagctaacattgcctcttgtcataaattatgggactcagttatggcagatgctattatactcattatataaaaatataagtttttttctctaaaccagcctctcgggagactggggcaggagaactgcttgaacccaggaggcagagattgcagtgagccaagatcatgccaccgcactccaacctgggtgacagagcgagactccgtcttgaaaaaaaaagaaaagaaaaagaaagaaagaaacatcagtgaggccagcctggctggaggcagtagggagccagggagcaagcagtagaaagtgaaagttgagaagagaaaagaagaactcagagagtcttctatgccaccataagaactagcgtttcccccctgggggagatagcagccactgggagattccaaggagaggaatgacaccggctaatacttgaacaagatcactacatcttgtcttctctgttgctcctggactgcaggggacaagtgtgaaagcagggagaccagctggggagctaccacaacaggtgagtcaaccactggtaatgatttggaccaggctgggagcagtgcacttagtgagaagtggtcagatcctagcatattttgaagagtgagttggtgggatttgctgatggactggacagaggtggagaggcatagaggagccaaggatgcctccaaaagctttggtctgaacccttactttggacatgatggtgtattttgtgctaattttaaaactgcatgaaaggtttgtgagaatgttaaaattatatgaaagtctgacttgaaacatgtgcaaacgggagtgcacactctctgggcaagtttatcatattaatatattccttcccaaaataaccctcagcctgacagcattgcagtgaggatggaaatgtgtgcaaatcctttgcaaagctgactcactgggcttcagagcaggactttaatcattgtttccatttgtttcctgtggatgaacagcaacataaacaagggagatcaattctgaaagcagaactccagtgtccccagaactccacctaggatgcctgattcattgtttttagcttctccaatagtgtagaatcttccccatgaaacccagaaagtcatcagctctcaaggggaaaaaaagaccaaatacaaggaagcatggtagggtgatgaggagattggagggcatgtcccttcagaagtgtcaaaggggctggagacatttcgcctggacaagaggtcagagaaagcaggagagccaccttccttcatgccatgctttaacttggtgcagagcaccaggacggattgggggaagacatagggaattctatttcagtttgaatttggaaagtacttttcattaaaccctagtagaccagagaacctatggaaataatgtatctctccacagacctttccagtaaatcttcagcctgactgggcctataagccaagatcatgccttgtttccacatccctcaccctcctcgtgttcatccgttcctgcatacccagcttgaattccttggctcatccctttaaatatttatatgcccatccaccccctttcattacatatgcctggcaaaaccccagctggttaaatctctgtctactgggcatctacaaagctcagcttggctggagaaaaacatatggctgtgttgtcctttctcacctgaaattcatgaccaccaacctcaagaagggttaaggctcccctgcactgagtctacagattcctggtccatccaacacccttctctcctagaggactatttcatatgttttctctctctcttcaaatcccctttttatcattctcagctgatgaccatgctttctttttcactgagaacacagaggcaatcccaagagacccttcccacatgccctctgcttgtatttctgcacctgcatctgtgcccagacacctgccttcccttgttttccaaccctggtgcaaaccatgtcctctctcacctgcgctattgcaaggttctcccaaccaggctctgagaccccctgataacagcacacctttccaaatgcaagtcagatcagttcttaaaacgttccactgacttcccattttgctcagaggaagagtctcaaccctcgcctgcaaagtcctcaggatctgactccaaatatcccatctagcttcctatgattatctctacactgacctccactctcatcttcaaagaagtggagcctcttcttgcccctgggcttttgcacctgctgcctcctctgcttggagagctatttcccagggatgagcgtgctcactcccttgcttccttcagtgctccctgcacaagtcaccattttagagaatcctctgaacaaagtggtgagctcttcaccctccccagcatcttctgacctccttgagctgctctgttttctacattggtccttgtcacaggccgaatggcacagtctgcatgcttgttacttggctgtgctccccgcttggctgcatgcttcaggaggacagggactttggcagctttgctcatgcctgagtgcttggcacatagaaagtactcaacagatatgtggtgagtaaataatcggatgagggaacggaaagtgtgcaagcatacaaggatgcttagatgcaagcaaggatggccacactggggagatgtgatagaaaaattcaagcatcgagcattttccacccatccttccatttatccaacaaatgtctactgcttgcctgctgtgtacaagctgctgtgttgggtgctaggggccataaatacatatggttcttacgttgaagggctcccttatcagggaagagacgggaacataatgaaatgagtacaacccaaaatgccaagtgacgtaacacagggaactgaaagtcctgtgtgagctcagagaaggccaatatttagttctggtagatatgtcctaggcagtgggggatggggttgaagatttcttatgatttctaaccctgctttcccggctcatgcgtctgtaataccaaaggggttgtgtccataataaaacaaaccagtgatgcagggacagcttgtaccattgaagcctcttgttttggatgtgttgactctttgttttacactttggaaccctgccgtcccgaagtcttctggtcttatctaccatgcccaggctttctccttatgtcccatcatgaacccaagtttccttcttccagagttcttgccattctcactatgcttagaagactagtcaagtcttctaaggctgggagaagcagggttgaggatcaggtttcctggctggctggttatctccctatcccctcagggattcccccagctcaatgaatgctggcttctaaaggctcagggttgactcttctccagaagattgacattggctctgaaggtggatccccctttcccagtgctgcctgcagcgagtgacagatgagtggtaggggtggatgcagcccccttacttcaagttgggtgactctgtggtgtgattatgccccagagctcccccaagtgaggctaaacttgaccagggagtgcagccttgcctggctccttcccctgctgctttctgctttccccaccttaaagattactcctgaagagcccttcctccacaagccatgtgtgcatcccaatccctgcctcaggctctgcttctgggcaattgactttctgagacaattccagcctgaaagaagaggttgtcagcagcacggtgtgttgctcagtcatggactaaactatgttcctgccccctggttgagaacccttgaacgcatgtaacctcgctcgggccaaggagattcatgcctgggactttaactacaatgattggaaggagaatttccatcaagctggggccatcttgcacctccacagaagaaactgcctgacaatgaagccaacaaaaaacaagctgagctgagaggtggagaaagagagagatttggatttttttaaggctcacctgttaaagccctaacccctaatgtgactgcatttggggacagggcctttaaagagataattaaactaaaatgaggtcacaaggaagcggccctaatgtgggatgattggtgtccttgtaagaagaggaagggacaccagggatgcacacacacagggagcacacagcgagaaagcagccatctgcaagccatggagagaagcctcgggaggaaaagacctgccgacactttgatcttggccttccagcctccagaactgtgagaaaatgaatgtctgtttgctgaagccactccatctgtggtattctgatatggcagcctgggctaaccaatgcatgcttgccacatacactgaaggctcctccagcaggcacctagagagacacagttattttctactactataaaatacagatgccttttaaagggttgaagtagaaaatgatgaaagcaaaaatagtccttttgacaacctgctatttccctggagtgatgtatgggatgcctgttgtttgtgctcaccgaacctccatccttcttctgggaggagttcctcaaatttccaccaagaaaccttcctgcctgtctccacctaaccatggcttcaggagtggatgcgtggtacaggcctggccagtcaacataaaatcactcatcattctcaaggcatttaagatgtgcttttttaaaagcacttaatccagagtgttagaatgttatttgccaggattttctaaccttggcactattcacatttggaactggaaaattctttgctgtgggggttgtcccgtgcattgtaggatatttagaggcatccctggcttctcctagatgctagtagcacccttgagttatgaaaaccagaaacatctcctggcattgtcaaatgtcccctgatgaggcaacattgccctctggttgagaacccttgaacgcatgcaacctcgctcaagtcaaagagattcatgcctgggactttaatcacaactatcggaaggagaatttccaccaagctgggcccatcttatacctccatgggagagattgcctgacaatggagccaacacaaagcaaggtgagctgagaggtggagacagatttggattttttaaaagctatcatctgagccactggattcaaccaagttatattttagttattgtgagccaagtaattcccttttgggcttcagccagtttgctttgggttcctgtcacaggcattcaaaaagcctccttagtgacatgagacactgtaaatttgatctcgttccaccctcatagctgctccctcaggtgggtttgtttatctgcactttacagatttaaaaattaaagggcatagcagctgcctcttgtatctctaccatccatgcacagcactgctcagaatcataaagacttacataatgaattactcaggggctgcctcctttgcccaagcatcaccttaagccccagatgttgtgtctttcttgttcactgaagccccagtgccaaaaacagtaccttactccttgtaggtgctcaaaaatgtttgtttggatagatgaatatggttacgtggcttgtccaagagtctggcccaggatcagatttcaaagcccatgtgtgttttcctatagtttcttatatgttttttctgctttgctccagacggaagaaccagatccaatgatatgtgtaagaagaataatttcagtgcaattgaaagaacagatgcacaattgactctgtcaagtgatggaatgacccgtctcaaataaagccaatgaggttggtgatggtgaagatgatgatgatgttgatgatgatgacactagtgaacaaaggctgggcgaagagtctgggtcaattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggcccgtagctagtgtttgtacaccaaacatagtcactgtcctgtctcatgagggaaggagggtcctgtcactatggtcatgcaagcagaggacagaggatgctaaatgggtcactgagcttcaaccagaattcttgatcgctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagctaggaacagccccactgctggagcagccagtgaccagccccatcggaactcttccccacttccctggaatgtctcccccagctatacctttgagcaccttccactgggcctcccaggctgccattgcagtttcctctccctccctgagaatccccatgggagaggaataacagagcatcaggaaggcgtttcaaatagcatcatgtcacaggaagagtgttggcctgtggtcaaacacatgcagatctgaacttcagttcaactccattttgaaaccttggtccaattgaccactgggtcttggactcatcatttgaaaagtgcaggtaatgatgcaaacatggagttttaagaagtaaatgatatatgggatgtcaaggacaaggcaggaggtcaatagatggtagctttctttttcaatttttgctccttttctccccagcagagttgctcttcaagctgaaacttcagcccaaatcaacttttactctcataatgatgaaaaggaaactggcagctgcttggggcataacaaccaacacatcctttgatctgatctttttctgcatcctcacttctttatgactcctccattacttagagattgaaggtattttcaaagttgttttctcttttgctttccttttccttttttttttttttttttgttgccatgccagtgagggtagtaaagctactttcattgccctcattttataggtaagaataatgctggctgagaagtgaggtgtcaaagtcccttgtaacacacctgatacacagcagagtcaggacttgctgagccacggcattctgacccgattctagtgttccttttcctattccatctgcatgggttcagagcctccttgaggagcagccttggggtataaatgccacggtcaggtataaagcaaggagacatcacaggccagatcctggggcatggggagtgactccatcccactaggacaagcaagaggaccatgggcagggtctggcttgggcaggaggcttagtgaccatgcctcagggaccctggccagtgatgccaatctgagtgccagcctgttgtcaaacagtcatggttttacagtacattcccagcattgggaattggcccctaactaagatctgcttggcatagtggaaagatcatgattccagcctaagctcagccacagtgcaagctagctaagcttgtgcagatgccctcacctctctaacctcccattccccatctacagaccccacagcagatagaaaattaaacaagagaatgtgtgagtggctggaaccttgaaggacctcagacaatggcatctctcactacatcatgcagtagttgtatttccaggccctgaattcccattaattactgctctgaaagtgggcttggggacaaggaaaatgtcagcacctcccctacctcacaggtatcacagaccctcataagcaccacttggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggccccatcagattgatgtgacgactcctccatcacttggagaagctctactctttccacacactgctcactggctcccaggatgctgttgttatgaacaagaatacagagaaagcattgtttgtggggattcattgataagtcaatctgctctgagagaaggattcctgtctaaaataagtgaggaatgaggctcacaaggtcaagtgagctgattggagagggcctgggtaggaaaggctgatatgaagtttttgattctcactgcttccttatttgtaatgtaaatgatctgaaatgacctaaatgtctctcagtcagggagtgtggctaaataaatgatgagacagccatatagtggaagactgtctaagcagtcaattttctggaaaagcagatctgtatgtacttacgtggaacaatttccaaggcactgcactgtgttttccatttgccccaacacccagatcaattcccctcccctccctgctctgctctatgccccgggagcatctcctggatggcaacatgacttcctggtttactggctttcacatgggtgtgaccagtgtgcacctctgcagcaggatggagggtgggaggagggaggggtcagggcatttcttccctgctcctcccccatgtgggtgctgtggctctgacacagcccagtccctatacgcttctgctgctgctcatcagcctgcagtccatggcttcagttatctttggaccttggtctctgatttcttcccctttcccctttgggcatttgaatctctccagttgaactgcctgagtggagttctgttgcctgtcaggaccctgacaatgacacagatatattatgaacatggagggcacccccagatagagacagcctcctactgacctcccaagaacctttccaatcatcttcacaattaacgtccccacaagtccaccgatggcgaatatggacacagtcacagaccagagcaaagtcagagtgtctgggtctattggacgtccatgccttctttcccatgactcattgtaaaaggccttgatgtactgaaaataaacaacaaaccatgttatttccttctgttctctcctgctgcttgaagcaagccagtgtacaaaacaaaacagcttgtacagagcattttcatgcatagcactttgctaatttgtttgagctttatctcattggcctcttctaacaaattttgggaagagcagaagatgttaatctttattatattcaaatgagcattttttttcttttatggctagtttttttgtgtttcttgcatctttgcctatcccaaggtactttttttgtaacaaaatgtttcctctttttacctcattttggagatagggaaactgaggctcagggagacaaagtgacttgctaggtaagtgctaaacctgggagctggactcagatctgaccccaagcttatgatgagcttcatagctgggcttctccaattctagtgcaccgcagcattgctgtggaggtgtgttaaagggcacataccgggtgggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctatctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaaggaaatacaacttcacattcactagagtctcatcgctgccaattctgattcagtgtgtttgggacagggactaggtgattctgatgtacaccaaagactgaggtccatggcactaagctccaaacagagttcagtccccaaggtacttagagttccctgttgctacccaacgtgagcccgcaaacctcagctgagccagtatatgacactgcagaaaaagcttaggttcaggtcgctcagacctgggctcaaatcccagcacaacttggtaatgatttaaatcagctgaaccttggttttcttatctgcaaaatgggaatgatgacattgacctctcagggctgttgtgagggtcaaatgagagcttgaagcagtggccagtacttgaatggagcttacacaatcccacatagactaaaaattaaaagatctggtaagactgaggagtgacaagcagtgtgttgtctgctggtaggagtttgacttgtacagccatcttggaaaacagctttggcatcagctagtcaaatggaagatgcctgtagcctacaactcagcaaatctacttctagaaaactcccctgaaaaactgtttctggggagccctaggatatatgtactcagatgtccatggcagcattgcacataataactccagacgagaaacagcccaggtgcccatggtcgatagcaggaataaacaaattgcagaatcatcatcatatgaaacatcacagccacaaacatgaatgaatacagctctgtccaaacacacatgggaaaacctggcaaaaataacaccaaccaaaagcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttctttttttttttttcaggctggagtgcagtggcatgatcacagctcactgcagatttgatcccctggggtcaggaggtcctggtacttcagcctcccgagtagctgagacagacgactacaggtatgtgccactatgcctggataaattttttttgtttgtttcttgtacaaaggaggtctcgccatgttccccaaggctggtctcaaactcctgggctcatgcgatcctcccgctgcagcctccccagaccttttattcttaacctggattgtgacatgagtgttagatttatactcagtctttaaagtgtgtgtgtgtgtgtacgggcacacaagcataatgcatatgtgtgtattttatatactcttttgtatgcataatacatgctgccatttaacatggaaaagaaaaatggtaggaaagtgttccaggcagagggagaattatgccaagacagcaggacagaagaaagcttgggtggccatggaattgcaaggaggccaataggggaggaacaggaccagaaagggaaggagtgggctggatgaagttggaggggcaagaaagggcaggtcatgtgggcctgataggtcatggaagttagcctggtttttacttggattctactctagatgaagtgggaaagtattggagggtttttggcagggggaggacatggtgtggcttgcattttcagaggatccctctggcaagtggatgaaagaggagctagacaggaagccaggcacacttggggggcactgcagtggtccaaagatcatggtggacttcactaagcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagcaaatggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccagacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatccaggtgccatctggttgcttcactctgctttccataattttgacctcatcctaagacagcatgcactcacaattgcaggatggctcctagtagcagttttggctacatgcttttctattcatgcatgactggagagagtaagcttggcctctcataggtctcttggtgctaagaggaactttcccggaagcttctaacaaacttctctttatgtcctgctggacatagttggggcacagatcccttactaaaccagtgtggaatgggacccatcagcctgtacctctgcccctgaattcctttcctttatctgttcctccctacgtgagtgaatgggaccaccattctccagttgctcagccaaaaaccacgaagtcattcttaactcctgcccttgatccaatctcctcaactaatccaccctcactcatccctgactgttagggttgaattgtatctaacctcacacctccagatttatatactaaagtcctaactccccaaacctcagaatgggtccttatttgaaatgtggtcattgcagatataattaattaagaagaggtcatattggagtaaggcccactctactccaatatgactggtgtcctttatagaaagaggacacaaagacagacacgggtacagagtgaattttgttcccctccaaacttcatatgttgaagtcctaacccctagtacctcagaatgtgaccttatttggagacaatctttacaaagcaaataacattaaaatgaggtcactagagtgggccctaatccaacgtgactggtaccctgataaaaaggggaaatgtggagatagacaggcacaggaggaagatgatgtaaacaggcatggggagaagatggccatctgtgagccagagagagaaggctggaactgagccttccttcaaagccctcagaaggaatccactctgccaacaccttgatcttggacttctgacctctagaactatggaataacacatttcagttctttcagtcactcagtccgtggtactttgttacagcagctctagaaaagtaatatattgcctagcttccaaaaggcttctcaccacttccaccattccaccactcaaccggtccaaactgccatcccctcactggggctaccaggacactgattcctgagccttcatcagggtgctaccagcagccttcagaatggccactatgttctttcttagtggctggacatttacctgacattgaccatttagtcaatgtcaaggctttatgtcctctattggacatttatctgccttttaggctccccagcatcagaagccctcttcccgcctgggagactttcctgcctcagaatcctgagtggggaaacaaaggacacataactacagaagccaaacatgccagacacccgctctcccagcatcctctgcagctggaagtggacatgtgaccaaggctcagccaatcagatgctggaactttgatcaaggtgttactggggctaagacatggggctgaggaggattctccagcagcagagggagctctggtgggattgggtttgggggcagcagcaggggagctgcaatgtcctgtgccagcggtgcagtcaatggcagtggtggctgcagcggagcccataggaccagctctgggagtgatttagggtagtatctccagctacagagcttccaggcctggctctccagccctcccactgatcctgtgagcaacccactcttttcaacaacttttttggctttagttgttccttacaactatggaaatacagaaactctagcaaagcacataaataatctcacttcaccctcacgacaaccctagtggtaaaagccctcatttacaaacaaggggcctgagagttatataacctgcccacagtcacggcttatatgcactgggaggcttttgtggtggagctgccaaacttcagggcacaaatacaactgctccacaaactgaactcttgaacttatgattaagatgtgaaagttaagcagataaacctaatggtgcatttattgatttaagagtaaatattggctgggtgcagtggctcatgcctgtaattccaacactttgggaggccaaggcaggcagatcacctgaggttaggagtttgagactagcctggccaacatggtgaaaccccatctctactaaaaatagaaaaattagctgggtgtggtggtgcacgcctctagtcccagctactctggaggctgaggctggggaatatcttgaaccctggaggcagaggttgcagggagccaagattgcgccactgcactccagcctgggggactgagcgagactccatctaaaacaaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcacgtgaacttgctccctatggcactcttatagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctctatagactctggaggggccagaagacttgctgcatagcctaggccccctgcaggaacacttttctcaaaagttccccgaaagctgtttgccccaatgcttttggcaactgaacgtttgtcttccaggtctgaattcagcaatagcccaggtgaaaggccttgttaccacaaggctgaagccagtgatgaagtttgctcagagaattcactgcactaacattccccaagcttgagatttgtgaacctcacctatggcaaaacatgactggtcatgcatgatacagaatgggtgcttaaataagaattcgttttgagtttctgctgtgtggcagtaaccatataataataaaacaggtaacccacacatcatagttacaatatgctctgtactattctaagaactggaggcatactgactcacttcttaccctccacaagggtactatttgttacctctgttttgggcagatgtggtatctgagccacagagccacaaggggccctcccaagctcacaccattggcatgcgatgtcaccaggactcagccccagtgagcagggatccagagtccatctcttaaccattacttttttccaactctaagtgtagaaaatataaagatgatgatatcaatacctctgttttaggggagaagaggagacatggaatgaagattggttgactgctaagtatgtatcagacatttggatatctcatctcattcaacccttgtagccatcctgagaagtttcattcacaacagagaagtctggagtggagaaacacatcccacagccatgccaaagatggtagaactgcagggcctgctagacctcacagtgctctcctcttcctggacatactgccaggccaccttacccagttccttgcatctaggtggggccatatgactacttctcaagcaaggagtgtaagtacaagggacatgtgtgacctccaccaagacgctgagaatgtgtttgcctgctccacgcttgctcctgtcagctggccagccacagaggatctagcagaggactccaaagtcctagagaatggtggaaccacttcacttaaggaacctgggtccctgaatggcttcatggagcagagtgttcctgctcatctccttcaaatgaggtgatataaatgggaattttcactgtgttaagccactgagatacagggcttgtttattacagcagcaagtttgccctgctgacacaatcaacgtaactacagagcccatgccatcacaattgcactgtgacctgaggcttcaagaaggaggagagatttaggccaagtcatgaaggcttggagatataaacctttacctagagctttccttttatgtgttgggagaactcgatcctgtttgaagaaaacaatctgcaataaaaatttgctttaagatcactgtggtaggtaacctctaggcctgctttgggacatctcactcattcctatcttacttgggattccttgttttactttttcattcagccaacagccacgaggcacattcttgtatctttctatctgactttacaggtctgcttcctcactaccaggggcccagcttcccatcctttcttctagatacaaattctgctgtttcttgccttcaaggagttcaagatctagtggagacagtagtcaagtaaacatacaattataacatggaataaaaatgccatgacaataggaagccaagaaaggctgtggaatccaagtcaagcaagcaagaagggcagacggagtgggctcagttacaggacgacaggcagagttaacagaattcttgaaggtgcagaaaccggagaccacaggttgccacacaggaggtataaaagacgcagtgggttgaaaggtggcccagtagaaggttggaggctgcctgtacctggctttgcctgccagcctcaggagtctacacaaaattccatgggcactggggagccattggagggttttagcacggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttacggctagtactaactacagcctaaactgcaaacaactgaataaaaggctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtagttggaattggcttttttccactctcagctctgccacttctttgctgggtgaccttgagtaagttacttaacctctctgcgcctcaggttcctcatctgttaaatcattgccctccttgaagagttactgtgaagatttaatgagagaatgaagatacagcacagtgctgggtcgatatgaagtacacaataaaaaccggaaattggggtggttggtggtagtgttgttgatatttttactgctatatttgtaaaataaggggcctaggctcatttatttgtcagattcaagaatccatgaatcacttaccattatctcccaggccaggaacctggggaccaagcctctggacataaaattgaactctgcaattcccagccaagactggcttagagcatctccaaataataaaagaaattgccagacaatgggaggcaaattacctcgtagcccgtttaacaatattaatgtgccttactgattcacacagagcctcccgtgaactcacttggaacgattctcaggagtcctgtaaaaatacacggaagtaacacttggtagctgggccagagtacacacaccattgcataagagaggaagtcatgccacaatgccttagggctttataaagacagtctgcaccactgaacacactggcacagggaagaacgcagtccagaagtccttaaaaaagtacccattgttgaaccaggccctctgaagttagggccccacaagaacaaaattccacaatcccagcagtgctacctaatgtcgcctggctccccgaggtaaggcctcctgtgtagaaaagagctctcacagcacgcctgagacttctcttcctagaaaagcctgctgcagggtaagtcccgggcttgcatctgggaacttggatgttggaagggttgccaccgttcccagatctggtaagagtgactcagtgtacctaaactgtgcaaacagtgtggtttatgctgtctcagtgtggtttatatctgctttctttctgggaatctggaattttctgcttgccaagcagagagtgcctatgtgaccaccccccgagaaaaaccctggactccaagtctctaatgagtttccttgttagacaaatttcacaagagttgtcacaactcgttgctgtggggatgaagcgcgtcccgtgaggctctgctagaagagttctttggagcttgcccctggtttcctctggacttcacccctgcacctttttcctttgctgacttagcattgtgttccaccactgtgatcagtcatagctgtgagtactaccgcattcctgtgccaacgcctgtgactcatgccagtgaattatcctacctgaaggtggtgttgggtgaccccagtacacctcccttgtcctaaggaaaaaactcagctcccattttggcttgacttgagcattaggtttgcaggtttgtggtgttttttcctcctccccaagtgattctcccagaggagcctggctgactcactgggaaagaggctcctgtgcctccagacacctgagactattttgttcccacagttagctttcagaatgaaatgaaacatgatgaaagaggaaacatcaattacaagcaacagccaggcaagtaaggctttcagagcctcctgggtttcccctcagccacctttgcagtgagggggcagccaaatgcttgggtttaattagttgaaacataaagaaggtaagtttcattgtctatttggccccaggcagaagcagagaagtgaatgcactcccaatattattcttattcaatcacagtcctgagccttcctcctgctggaacattcttttgagaggttgcatagctgtgtttacagggaacagtgcattttcgcagacttgagatgatattttgctctcctttttgcatatcctccggttggccggaatgaaaagggcaaattgttttcattaccagtcaattcacttctggatgcttgaggtagcaggggccccgtctgcaacatcaattctggaataactcatttatagaatgggaataagaacccctagcttgtagatgaggccgccagaaggatgaaatgaggtgtgtgaagtcccgagcatgatgtcagcatacagcaggtgctcaataaatttcagggtcttcccctatgggtcagaaatagggtgcttctagtttcacttgtctggtttgttcacaccagctgtgcaactccaacacagccctccaagtttccctacctcccatcttgctggatcagctatccccagctctctggctgcagcaaccactgcccccactgcactaagctgagcttcctggagatttgatgggaccgagttcctttccccatttggctcaacaaaggcatttttcttggagaaactttatgaaatgagaaaattctatatcaaagaggcaggctgtccagctctaatcgctgggacctccagggcatggtgcggggggagttggcactcacagcctgggacacctggacaccaacgccccaggctggaaaaggtccctgggccctcatcagtcagcagctgtgctggctctgatcaaatcaaaccaaaccaaacaatgactcacagatcccaatttaaacaatgcagcagcatctcatattagagaaaaattggaaacaacctcagaggcccacattaggaagataggacatcacaggaggcagctccacactgctgttaaacatcctggtgatgcagaacttccaatagcatagaaaggtgcttacaaataaatagtaagccaaaaaagagagtattaaacagtatatatgatgatcttcagaaaaaagagtggatttagatgacacattaaaagcggcctctggatggagtctgggttttgactgtgttcaggcccaagtgtaccatctattagctaggtagccttaggccagtcactcaatctctcccttatttgtaatacagggttatcagcataaatctgccatgtggggctggtatacaaatgagagagatcatctctcactcacagaagaatgtttgtatgtgtagcttcattatcaaatttctgtgcggtggtttttttttttttttttcctaatggaagtctgttgcttttatagttactgagataaagtgagacaaaagcaagagtaaaactgaaaagagcggggggtgaggggacaaaactctgggattcagagatacccatttcatagacataattgcccgttgtttctgcagtgacacaatgcacagggtcctcctgtaatctcagccctcttccaccaaagtcttgagccctgctatgcctccccctcaccccaaccagaacttatgtcgtttgacacagtctctgctcatcattccctcctggtttccttgagaatgggtctcaggccacaccagaggcacctgccaggcgacatgcttctttctctaagagcgcctgggttcccagagcagcctgctaagatggcattatggggtgggattaactgaaagcaccagaacttgcttttgggttctctctctgttggttcacttgaatcttgtttgatcaggttctaacatctgtggctaactgggcagctctacccttatagagggaaatgttgattttgctttttattatcatttgtttatctgcctttagggaaggagcagacaggagaaaataatagaatataccatttatgctgggaaatgcattgagtcaacttaattgctctacagaaaccctgggcttaaatactaacaccatgaaggacaagagtctgtgtctcccctcccaagaagacaaaacatggctaactcaaaaaccactggaaaagtgagtaatttcttatcaaagccaagccattcagtattatttctgtggctgccagtgttgtttcaaataagtcctaatttatattggatggtgtggggccaatgagttagactcctaaagttaagttctcattcattctttctcactccttccttctctcactcactaattcattttacaaacattttttgagtattttctgtttataatatgcatttgtgtaatgtaaatcttatatacacagtagacaactgtataataaagtttggctggcctttgtccctggttcttgggatgtagcctgtgaattcttgggatttcttgagttattcatggcagacctctcagaatcccttgatagtgtatgttaacaagataactcaggatgggggttggccatgcaagaaagaccagccatgtgatagagggttggggctttgagccaagtgacatcagccctacctccagggaagagaggaggaccaaagattgagttcaaccttatggccaatgatttgatcaatcacatctacatgatgaaaccccaataaaaatttggaacactgaagcttgggtgagcttccctggtagacaacactctgtgggaggagagagaacaccagagctggaatccttccagaccttgccctgtgatctcttcttgtggcttattctgattcgtatcctttttgctataataaagctgtaattctaagcatagcacttcctgagttctgtgagtcatttgagcaaattatcaaaccagaaggggtagtgagaacccccaaatgtgttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgcgaggtactttgatagacgccagggaaacaaatgaacagtattgttttaggtgacactttgatctgtacaatcctgactgctatacttttgccaagcctccaagcatttcccccaagctacaggccagaaactgcacaaacaggcaccaagttcactgtctacccttttgattagccctgaactgtcccgcccacctcaccttctgttcccccaaccactgcattccctgtttgctttctaatttttattttcattcataactcctattcaacacattcattatctcaactttggtccttttttcttggcgacttttcttaatgtccatcccccagtggtcgttctgcctaggctgactgttctcttgggctcattgcaatgtgggatcctcctacaatcataggaagtgcgtgagtcccaggtcaggaatccatccaggtccatcacctcaatagttgcttctcatggatcagctactcttgaacccctcaccctttggcttgttttttgtcttggttgggcccttttggactgaagtctgggctccatactgtcggccctgccacagaccttgcatttctttagaacattgcttccagaatcttcctgtaggctctgtggacaacacccatgagcaagaggagctttgactcatgctttgcccaggcaccaccatcccacccaggcctgtatcagccctgtctgcccatttcagtccccagagaatgtcccttggggctcagaaccccccactccagtctgtgggtctccatccagcccttaacaacctctcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgttattggcacataccctcacccattcatttacatatcatctataactgctttatctctacatagcagagttcagtagttgcaacagagaccatatggccaacaaagaaaaaccacgcactatctggacctccacagaacatttgctggaccttcacagaacgtttgctgattcacagaatgcagcagatcagcctagtggaacagaaagaagggatactcaggaattagacagaccagtgtccaagtccccatctgtgaacatggtggaggtggtcccagaagttttccataggacagactcacagctggcaatttgtttgagagtgaagagacctaaggacttgccttggactcactttaaatttaaatttatccatttgctcatttagcaaatattttttataaatgcttacaatgtgtcagacattgttctaggtgctggcactgcagaagcaaggacctttctaaagtgaagggaaggaggacaagaagtaaaggaatatgtcatatctcaggtagtgttaaataccatgaggagaaataaattcggtgagggctaaagcgtgatggaggggtgccattttggataggctggtcagggaagacatttctgaggaggggacgtctgagcagaggcaagaagtaatcaaaggagagtgcacaggaaaatcaagggaagagcactgcagccagcaggagcagcacgcacaaaggctctgaggttccagcgtgcggtgtgtttgaggggcagcaagtggggagaagtttgtgtaaatggagaagagggagtgaggggggaaatgatgatgacagagtggtcacatctgtcatgtgtcatgtgtcacggccccaggtaccgtgtaagtcaccacagtctggcttgctttctagatatagtgggttttgagcggagggacaatatgatcttgcttcatttgtcaaggatccctttggcctttgggtggagactaaactgtaggaaccagagtggaaacagagaaaccagttagggtttagtgtagagaatgaatagagcctagctactgtggtgttcatcttggtgatcaacgcaccagcacagcacagataaccctgattttcaacagctaaggacaataagaacctcttgccagttcatgcaaagtccagtgtgcgtttaatagttctctgccatctgggggaagaaaggactgaagatctttcttcagtgctgccataaccagggatgctgccataaaccaggcctcatgtggcctatcagcacctctgttcacatcccatccaccaagctggccaaggacccttgtggatgcacgaggtgcaggtgttctcttccaaatgaggcatgaaaagtagtcagatcctggggattcttggaaagttgggtggccaggaggcacatccaggtgactgtgttgaggagaagccagtgggaatgtttaggaagtgtcccacccctgaaacttggatgtattgggttccctcagcctcagtttcctcgcctttaaaagggggttagtgatagctgccttgcaatattataacaaggatccagtgtgcacacaattctgaacctgggtcaagtgcagagctggtgcccagaggcgagttattttcattttcggcattacagaaagtttccaaatatctgaggagagaggagcactgagcgtttttaaggttgaggctgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgaggacttacaagcctgggccagtgctaaaggcagcacaccttcccatggggcagcatccacacaccaccccctggtggcagcctttgttcatcatctctgtgagcagataccctccccgcactccaaagcagcactaatatctgcacctcttctgttccaagggtttctttctccttctcgagagcccagcaccccaggtgaagcctagctctcacaccctaaacccctgccaggcttgggtccttccagcctgtgttagattccattccttagaggctctgctctgttcctggtctccctggttctggggctgcctcactcacccgtttctaagcccactgcaaggagaagagagaattcgaggtgatcgctggacgctgggctgagctcctccagcatcacatctcctttcatttcgcagcgacctcacaaggggctcgacaccagccctttacagaggcacctacatggtgcctgggattctctgcaggattctgagctgggattctgtgcaggcctgctcagctcacactcagggcagtttccacctcggaagggcctcccagggcgagccttggccctcagcctgctcatagcctgggtggtgctggatcatgctcctgttctggcctctgcaacctttctgatctggcttcagctcccctttccagcctctacctctccaccccactggaccccacatccagctacccttaggtctccaccattcccagaaagccttgagctctctctttcaagccccagtgaggccccactgacctccccaggtagaatacagtccttcagctgtcctgtggctccatgcagcctgtctcactggtgattatttattgagcctctgtcactgctgctggtcttggggcacctcgaggacatggatgtgtgtcgttttcatctttctaccccagatacagcaaggtcaacacccagggaagggcactgaaggattgcctgaacagctacccctctcttctcacaaagcagcacaagtaaacataaaacatcaggacctttaggcagagcaggaagaggttacatgaccccaaaccccatagggaggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgatggcagcatcatccaccttatgcttgagcccctagggttgttgcagtgaaaccttgctctgtcttttggttggtagatggacaggtaagtagccctgggcttgctgtggctcctcccatctccccttgttcctctttgcctttattgatcatgccaaactccccccatggctggactgttggcgcctgccattagtggtcaggggcaggaaggaggggcagagagcatggcacggatcttggattcagacagacctgggtttgaattccaacactgccacctcctggctgtgtgaacctgggcaagttgcttaaactgagcttctgtttctttgttcatgaaatgaaggtaacatcagtaattaactaccttgacctgaattgtgtcccctccaaaaatgttgcatgacatttttgttgcaaggatagggcatgttgaagccctaaccccgatgtgatggtatttggagatgaggcctttgggaggttactggggttagcagaggtcatgggggcggcctcatggtgggatgagtatcttgctcccttgcactcttcctccctctgccatgtacaggcagtgagaaagaggccgtctgcaagccagaaggaaggtccttgccagacaacgaatccaccggcactttgattttggatttccaggttggagaagtatgggaaaataaatgtcttgctgaagaccccaggctgtgctgttttgttacagccaaagacactgacgtctctgtatttctgagaatggaatgcgcctggcatgcagtacattttggcagagttgatgagctggccatcacagtctctgctcctcttcaaaggcagagagcacatgctgggaagtagctacccaactggggatgacacttcccaggccgtggatctgggcagatggctcagtcctggactcaaggcctcctcggggtgcttgctctgggctcctctaaagtatgcatgacgagccgtggtctcgaggttcaaaggacaccaggctaaaaagcgccttgtgatgtctcaagactgaacaccttgctgcgcatactggccacagaggtagagctccgatatcccaaacaagaagtcccatggcctaacactgcctggcacagaaaggatctgttttaaaaatgactgaaaatgtgtctgatgcctgggaaaccagaagcccgcccagggccaaactctggctccactcattatgtgactgtgggaaagtcagtgaacagtgtgcctcagtttcgtcatctgtaaaatggggataatgatgatccatacctcacagggctgtcatgagggtgcactgagctgattaacgcatgaaaagtacatggaggagggccggcacctcatgagggctttttccatctgtgctcttactgatgctgccataatatgtgtcactcatcttaagaacggtaaaggccaccctggctgtgtagatcttcagaaatctcctttcccgaaacggagggagggcacgttaaactctctctgtttggcttaccatggtctttcccattaaatacctctaagctctggcccctcctgtccttctcactgacaccaaagttgtttttctaaaaaacagtgagcatattaaataagtaaataaataaggaggcacgtgttctcaggacctcctgagggtgtgtcatggttaaagaaaaataaattttaattaaaaaaatgtgagttgcaaacccccacccccatgaatctgccatggctccctactgcccaagactaaaatcctactcctcagcctaagatcttaggccctcttcttttgactccatcctgcttttccacctcttctttcatcccagctctgcattccccctaggtactggcacatcacacgctactaacttcctaatatgccaccatgtgggcacagccaggcctctgtgtgtgtgcttcagctccccacctccctttgacacctgtggaaattctacacatccctcatgactcagctcaaataccacctcctccaggctgtcttccctgatccccagagttggatacattataaactctcaacaatgcttgctgaatgaataagtgagtaatgggattcctccgtcctcatgttcccatagtcagtgcttgaacccatatcattctatcccaggtgtaagtttcacataactctgctccacaagccatgagtgcaaaggttctcccccacctctcacctggatgttttgatgaactttcaagatgaagcaagagtccaaattcctagccctctttcaaagacaaatatcgacaagccagatccccatcttggaatgacgtcacaatgacaaaatcaaagatcactgactgttggcagtgcttactgaagccatctaggccccctggttttcaaacagtttttagcaacagaaatgaacaatgtcaaataattaacagactttttaaacatagaactgacctgcgcaaatagtgcttagatccgtgaggcacctctgcaaaattccagggctcatgggaacctttgaaactcactgacccaggcttcccctatgttttgtacacaaggatgctggactcccaagcaaggaaaagcctggaaggcacccagggctgtcctcagcctgcttcctgtctgcccccaaaacagcttgtgctccaagaacctggagctccccgcatttccccagatgtgtcctacatccgtgtccccaaaacggcctgtgctccaagaacctggagctccccgcatttccccagatgtgtcctatatccgtgtctccaaaacggcctgtgctccaagaacctggagctccccgcatttccccagatgtgtcctacatcccggccccccatccatcactccaccttccaaacttagtcaggcatcacttcctgcaggaaagcttccctcaagcctccaacctgcccttgcctgtgggtggtggtaggtcaaagccaaagccagcacccacaggatagcatctaaaccttacagcctaggtaggcagtacccaacctttaactgcaaaccagaggcacaatgtgaagagggcctgggagaattgcacctggatctgatttcagagtaaaacacaagccaaagatgggtcttatccagcagatacctgagtggcctctggttgtaatttaaagtcaacaacaccaggccgggcacagtggctcaagcctataatcccagcactttgggaggccaaggtgggcggatcgcttgaggctgggagttccagaccagcctagccaatatggcggaacaccacctctacaaatacaaaaattagtcgggtgtggtggtgcatgcctgtagccccagttactcgggaggctgaggcagaagaatcacttgaacgtgggaggcggcggttgcagtgagccgagatcgcaccactgcactccagcctggtgacagagtgagactccatctcaaagatgatagatagatagatagatagatagatagatagatagatagataacaacaacaacaaaacaaatcaagaaaatgtccaagtttccatgcataaggcccctcctggttctttccccggcattaggggccagaggatcgccccccaccccaccccgggacttccgaagccccctctcatctagtctcccaacgttctcccaggacacccgccctccagccgcaagaactgtcatcccccgcccctgtccccgtgtcatcattgtctgtctctgtgcctcccctctcccccgagtgggggctaatctctgtccccgcggtgtcccgcgccgcgagcgcaacaggagggggcgctggagcccagggcccttgcgcacccgaaggtttccgcagggccgcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggaagacctggaacgttccctcagctgggggaggccttccggaggagaagtctttgtccttggctggggtagagacagagagaagagacgcaagttggggacctgcaagtagggttccagtccaggtccgcgtgcgcaggccgggcgccctcaggtttagcggccacgcccttgcgttccttccgggttgcgtgaggattcctgaaacgcagttttcagcagctgctctgggcagctccacacgatcctttcagcgaagttggcgagtgtccgacccagacagaaaaaagcaaagccagactccaagcgctatcagccaggcgtgattctaagcacttttctgcgcattgtctctgagtccttagatcagtgctgttatgtcctgtattacaggtgaggaaagaggggcagggagcgtggctggtgctgtctaggatggggactgaagtccaggtggcctggctgcagtgcccctctagtcaccactgcactgtcccctgctgacccgtcacctgagtgccgttgtccaagggcctgagactgccgacagccagacagatgtgcacacacgcttacatgcacatactgttccagtctgaggcgtcaaactacaggggctggtccaagcctcaggacaaggacctgcagacgtagagatgcaaggtttggcacagagaacagggcgcctgccttggtgttgtcctgccctgcagccccatctaaggacagccaccaccagtacagggccatagggcagaaacacctggatccctggcaaaggctgacaagctggcatgagccagggcaggagggatggctgtcctcagctggtcagggaatacaggccaagtggacaggggccaggtgctccggaaggcaccttctttgccatcatttgacatatttgtgagtgtgtgtgtgtgtgtgtgtgtgtgtgtgtgtgttgtaggcgccaggccctgacaaagctgtgggggtgcaacagtgaagaagacatatggatccatggttcagggacccatatcagtcaaatcccgtctggaagggaatgcgggtctcttgatggccacttacctgctctgccagtctcgtttgtctcctctagtgccaccagccacgagatagagctttggggctttgagccaagtgatatcagctttacctccagggccagtcccctcagctgtaggagtctgagcaagtgacttgacttttctggggctcagcttgcccacctgtgaaatgggatcttaatagcagcactggccacatatgttgttgaggagcctgctgcagaggaggtgctccgtagaggctgctgatcacatgcgggggcaagagggaacatttataagccttggggatgggtgctgccaattgaaatgtagtaccagaatatttttctgcagtgagaggagcttgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgaccttagaggacacaaactcctccctggtctgcaccccatcagattgggagcacctggtgtgaagtgcccctgccagaggctggtgaagggcaggtgggggccatcttctcctgcctcagctgtgctccccggagccccctgcctgtgtggcccgcctgtgccctccacccgctccccactcactgcacgggcagagggtgcccactgaccgacggtgctgctgcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctccctgcctcaaagccccagatcccccagctacacgctgccaggctggggctgagcactgtcacacggctgccacccaggcctgccttccccacagcccgccagccatgcagaaaagctgtccgtagttacctttcttctccttccacctggcaccccactcctcaggtggtcacactccagcagtgccctccctggccctggaggcccggcgtggctggtgtcatctgtgaggggaactaggcccagttccttggaattcctattttgtttccttgccatgggtctcagtgacccagctgatggctcagtccagggaccccagactctgccaaggcatttccgtgagtgaggaggcagagtccactggaaggagggcgggagttcctgacaggaagtgtggcaatttgatcatgcctgaacaggcaacggggcaacatttttttctctgctcctaagttattacagcaatgaaacagtccaaaaagggaaatctgtcctctccaggattgccacccagggggtggaattttttttttttttcttagcatctttttatttttctctggtaacaaagcctggagcagggtgactgccattaacctaggatacctccctaatgcttggaacagaatggagaggtggctgactttgactcagaagcctgcatacagctctgcccctgactcttccactttttttttttttttttgaccgaatcttgctctgttgcccgggctggagtgcactgatgcaatctctgctcactgcaacctccgcacctgggttcaagcaattctcctgcctcagcctcccaagtagctggaactataggcgtgtgccaccacgcctggctgatttttgtatttttagtagagactgtgtttcaccatgttggccaggctggtcttgacctccttacctcaggtgatctgcccacctcagcctcccaaagtgctggaattagaggcgtaagccaccatgtctggccaactcctccactttttaactgtgtgtcctcaggcaagtcactttattctctgagctgcaacttctaccactgcaaaatggaatattgaccccactctgactgtcctgcagacttattctgaagctcaaatagaaaacagccagccccaagtggcgtgctgtaaatgagtgtgggctctcctgtagcctagaacaaaggcgagggctgtgggtttggaagaaaaagaatttgcctcttagtcgttactctgtcctgctcattcagcactggctgaggggacatgtcctgtattccagccccaggctggctcaaggacagtactgagaaggcaagggcctcatgcacaccaggaggttgtgggaatcagttcatcacatggccatgttgcctcagacgccagagaagcaccttcaattttggctagaacagtttgctcccagaagcagagagcagtgcagagtctgggccagagccagggacaggcttggtgaatgcagaacgtccaggaggcaaggtagggctcagtccacaaaagagagatcgaaaagttagcaaagtacgtttagtaaaaagcacacaataaaataaaaggtgtggagtacggcagacattccaggaacctggaatgtgaaacgcacgtggaaacgtccggccctgacatgcacggtggtgggaatgtggctgctcaaagcaagtggggaatcaagacttccaaagaggaaaaccaccctcaggagttaggttggggatgtattgagcacgccagtcattcagtgcaatcgtccttctgtgtgttaatcagtcaggcatgccccgggagaagtggctgtttcttgaactggatttcagctatgcagcctggtttcctcattgagtggtgggcctagagcagcattctgatgtgcaaatccttaattataacatgacctaaaaaggcggaggattccccaggacagtgtggaggaggcaccacatcaatctcagctggatcttggagaccccgctggaagaggcggcttctgagcggacagagaaggatacggggtgagaggacaaggagccaaggcctgcaggcacagatgcctgcagtgtgtgggaggaagtgaaattgtcagtgaagcatggttggggcctgaagtacaggagatgggcagaggaggggcagggacagctgcatccctgtgcatggagggcccctctgcccctatgctgtcctgatagggactgcattttcatcatctcatttacccctcctcatcccattgctgtgactcccctctctataccctccctgtttcctcatctgtaacagtggggacctcaccagattttgctaaagctcaaattggatcaggtgtcccctcatcccgttaaaaattgcttcgtagtcctctgttgggtttgaaaactcaaaaggaaccagaaattaggcagtggacatgaatgtgcagctacagctggacagaaagtaaaagagcggagatgggtccctcccggatccagatggtagctaaccagggttcctggtagccacagcacttgcctcaccttcagctcctactacatgtgcacagctcatgttacatgtgcacagggctttcccaagtgtgttcaccttcatgatatcgtttagtcctcagaggaactatcagacctacatttcggggcaactgaagttcagggggagcatggaggagcctgcctccaaagcgagggctggttccccattccacagggccatcggccctgcactgcaggcaactgctaaggaagcgactcctatcacagatgaagtcataagacaaacatccccagatgttctgggctggggcacgttctgcctgctctgacactcactggttccttcattcagtcattacttgcctgtctttatgaagctcctactcattcaggttctcctgaccttgctcaggccctcacttctgactgccctgaactgtgctcacccttcagcacttaactctctcgccacctcctcccagcagcctccccaacctctcgctgcctctgtgctccatgtgtgccttcccctctgcacgtgtgctgctgctcacgtgtgccttcccctctgcacgggagctcactgtgggcagggatggtgtgcgtctcaatgggctgattgtgtcccctcagattcacatgttgaagtcctcaccccaagtacctgacaatgtgactgtatttggagatagggtttttgaagaggtaattaaggttaaatgaagtcatatgcatggggctgtattccagtatgcctggtgtccttataggaagaggaaatgaggacacagacacacacagagggatgaccacgtgaggacgcagggagaaggcagccacttctgccaagaagggaggcttcagaaggaactaacctgctgacactctgagcttggacttctggtttctaagactgtgagacaatacatttctgttgtttaagctgcccagtctatgggactttgtcttggcagccccagcaaacccacagtgtcctaagcctctttgtattcctagacttccttcagcctggctcagggacagggtccagtagataggcatcacttctggaactgaccttaaactgtcctccggatgatttcctaaggctaaaaagttgtcttggacaaggtggaagttttctagcagggaagagttggaaaagaaggggggttttctattgagtatcatttaagcagaatgtttgaaatgactacatcccttccttcattacaccaaatacttagacagtagatccttgactcacctaatgtaagcaccaagaaaagatatagcgtccacttagagggaactgctgtctatttgacattattcttgcgtggggtcttgggtaacctcaaacaggtgactgcacccttatcctccatttcacacctctgtggggacaatgatgttcagcttgccaatttcacaccttcttgacaacttggtaaatggacttgtgttgatctctgtcctaccaaatacaggtttattataaatacaaataaattttccctggagtcacagtagcttccacacccatcacaggaggtgaggcacagataatccaaggtttaagaagggctcaaacctgtactagccacatagccttggacaagtggcttcatccctttctgagcctcagttcatcgcctgtaaaatagggccagtgatgccttcagcatggtttgatccagagagaaccatgtaaagagtctctctttaaatgagagccctatgtaaaggtccagcacagagtaggcactctctggctgttggttcttgaatcaggtttaaaaagagcatctgatgagtcccaagaagaaagaaagtcattctattaataggagctgaggacttcctggaggaaggggcaggtcgactaagctttgtgatggattaaggggtgggttttagtgtatctttaacgatgatgacataatcattgtcaacatcaatgtccccttgttgagaaatgacctttgtaatggagacttttgccccaagcccagaaagtcaccagcagatcaggactgtcaatttcactcttctgagcctcatcccagacactctacaatccccatggctccttcccatagaacttggctttcagctgctgctcactcttttctctgcccagcttcaccttaacagcctcccactgacccaggggaaaggggtactaccccctgggtgaccggaataatcatgtaagggagacagaaaaaaaaaaggactgaccaatttctttttcgctgaatcactttcttcatcttctcctcggtcctttttactgagcttcatggttcacttttcaggttttgaacttttgttgttattgtttctgagaaagagaaaaagaaagaagccattagacagctgctttctcagatgtgcaagtcaggggaggtggcctggagcagtcttcgaaaggtttgctgtgaggagctctggctgggatgccaggataggacacagcagcatcctcgcttgggcatctccctgctctcctctgtcctcagtttctctatttttgagtgcagggcttcccacacttgccttgttgattattaaatacaggcaatgatcccattcctcttctgcatcatcaatttatctctctgtgttggatctccccgggctatgtacaaaaatgtcctagtgtcacccatattttttttttaaaaatcaactaaaagtttttggcaaggatgtggagaaattggaacccttgtataggattgtctttgctagtggaaatgtgaaatggtttagctactgtgggaaaaagtttgcttgtttctctaaacataaaatcaccacatgacccagcaattccaccaccacatcgatgcccaagaggactgaaagcagctgctcaaagaaaaacttgtgcacgaatgttcacagcaatgatattccaatggccgagaggtggaaacagcccaagtgtcctccaatgaatgaatgaataagcaaaatgtggtctatccatatagcggaaaattactcagcaataaacagaagtgaagcgctgatacaggctacaacatgaatgcaccttgaaaacattctgccaagtgaaagaacccagacacaggccgggcatggtggctcatgcctgtaatcccagcacgtggggaggccgaggcgggtggatcacctgaggttgggagttcaagaccagcctggccaacatggtgaaaccctgtctctactaaaaatagaaaaattagccgggtgtgctagcaggcacctgtaatcccagctactcgggaggctgaggcaggagaattgcttgaacccaggaggcagaggttgcagtgggctgagatctcgccactgcactccagcctggtcaacagagtgaaactctgtctcaaaaaaacaaaaaaaaaaagaacccagacacaaaaagcgacatcttttatgatttcatttatatgaaatgtccagaattggcaaatccgtggagacagaaggcagatcagcggtggcccaggactgggggaaggggcagtggctgcagcagcctcacagataagcagcagttgcccttgggagtgatggaaatgttttggaactggatggaaatggtggctgtacaagaatgtgaatgtaggaaatgctgctgaattgtttactttaaaatggttaatttttccctatgtgattttacctcattttagaaaaaaacgtgtctttgatcccgtcgcctcctgtttaccaccccattttcctgctccctgttacagcaaaacgatcccaaagagaactcacttccccagcttccattctcccctcagcaccgcaccattaaaattgatctgaatgagctcatcaacaagccacatcttgccagaaccaacagtcaatttcctacaacctcccggcatcttcagtgaggttgacctctcctcttggtggtgcggtggtgccatggagcttctgtcacagtggtggcagcttctgttgcagtggtggcagcctcctgagtctggagcattggggccgagtgtcctttggtaatgggggtagaactgcctacccaggcattttttttttattgatacatattagatgtacacatttgggaggtacatgtgacaagttgatacatttgtataatgaaaatcagggtaattaggacagccatcaccttacatctttatctttacactagaagcattcaaattctcctcttgtaggtattttgaaatgtgcggttgattaataactatagttaccctgctgatctacggaacaccaggctttatttcttccatctgttgtatccatgaatccacctctcttccaggctgttttctgcacacttccagagcctggatctgcagcctccccattgatttgctcacgagcctcccattaaattccctttctgcctgggcccctccaggagggtttctgctgctttgaccaggaacccagctgcccaagcagccccttcgagctgccacaccaggccactctgccctcagctccctcatctggttgatcgggggtcccacaggaccaagcaatttcatggtgggtcagtcctgatatggatttgacaacttgggtaaagaaatgactgggagtaatgtgactcccttttcatgagaaaagcccataaatgcgaatgcagcactcgaggtcccctcagaatttcagtggttgaaaagtggagctggatgttctaagactcagaccctcatcctggctcctcgtttgatttaagaaggaagacaaggccttgacatccacactggctgaggttccaaccctgggtctgcccccagccagctgtgtgagctcaggcgactgagttaacctctctgagctcagcttccctacctgcatcacaggaaggacaacattatccctgcatagagaccaataataatgcatggacatcatacacagcacctagcagagacttgtaaattgtagacttttaatatcctaagtcatggtgccttctaggaaggggggcggttacttaccattctgcaatctgtctaaactgaaccttcctgcaagatgctgcccagggaacattcctgccaaaggcaccctggcattaggtcagagtgctgcctctgcctccttcctgtcctagggaacctgctggatgggctcagagaagcggtgcctcccaagcactaatcacagaacttcccccacagcatatccagcactcccagcattgcagcctctgtgcccctcaccgccctggggtgaagcttcagcccaatcccttccagccttcaaagtctgaagcactaatcacagagcttcccccacagcacacccagtgctcccagcactgcagtctctgtgcttctcactgacctggggtgaagcttcagctcaatcccttccagtcatccaagtccaaatgcctgatgacatcctcagagggctgacatctgcccagtctcctctattggacagatccacagggtgtctctgtttttaactgggtgtggccttgacctttgtaagatgagcggctcctgaatgccttccagacgactaggacgaggttggctgacgaggacatagattttctaggctcaactcttggaattctcatttaatggatctgagatggggcagggcatctgaatttcaccaagcaccaatctgccctatccccgatgcacagtctccaaccaaaccattggcttctcagtgcctcccagactctagccttggcttgccaccttgatgatgggatgctttaggtagccttagctatcctttttacttggttgtgtcctaagccaggggttcttaccctggctgttcattaatgtataaatgtacaatgtataaaatcccaaagccaggctccttgttggacaagaggaattttttaaatattttattttattttatttattttatatttttattttattttatattattttattttattttattttaattattttattttatttgagatggagtttggtcttgttgcccaggctggagtgcaatggcacaatctcatctaactgcaacctctgcctcccgggttcaagcgattctgctgcctcagcttcccgagtagctgggtttataggcacccgccaccatgcctggctaatttttgtttttgtttttgtttttgttttttttagtagagatggggtttcgccatgttggccaggatggtctggaactcctgacctcaggtgatctacctgcctcagcctcccaaagtgctgggattacaggtgtgagccaccatggctggcagagataaattttttttttaaagctccttgggctgttgcaaggtgtggtgctgtttaaagtaatcactatcttaagtaatgatatgcatgaaatctaatggtaaaatatatacataaaaagacatgcatatatatgaatacccaaaacatgttcatgtctatcaaagggaacaaagtttccattagacaggaggataagttttcctaatctattgtacagtatgatgagcatagttaataataatgtatatttcaaaattgctgcaagactagattttaaatgttcttaccacagaaaactggtaagtaggtgaggggatgagttagcttgatggaatcattctatgttgcatctatataccaaaagatcacattgtaccacacacatatgtacaattatttgtcaatcaaaaataaataaataaataaaatactctgtatgatactataatggtaaatacaagtaattatgcctttgtccaaacccacagaatgtacaataccaagagtgaaccctaatgtacaaaatgacctttgggtaatttggatgtgtcaatataggtcccttttacattgtaataaatgcagcatcctaaggggatgttgctcagggtgggggtgataggccattcaagtgtgtgggtgtaggggggcaggtgggaaatctctgtaccttcctcataatttttctgtgaacctatcgtaaagctcctctaaatacaaaaacaaaaacgtgctcatccacaaccaaccaaaagtcatcctggctttcgtgttttgagaaactctaaactagatgctaaaaggcctttcccatctttctggtccaaatctaggaaatgacaggattcttcttatcgagcccctcttatgtagtagaccccaccaggccgctttgcatgtgtgatggcatggcgcatagcagcagccctcagcagaggtcatgatcagccccatttcatagacctggaaactggggcttaggggctcccaaagctgagtcttctaaaactaagaagttagctgcagagaactcaaccccagctgcacgcctctgctttctatcatgtcaggagcagaaaagtgagtggccctgcctttcagggggcttagattgaggagctgggattccatttgtgttactggtttgtaatatcagctaagcagaggccttccaaaggactggcaccagggaccaggaatgctcagatgagcacgtcactctgcagacagtccagatttagcactgtcacccatgccatttcctccctttgatttcttccaacatgagacacaaaaggatagagtttcactcatataagagaggtccagctttaataatcagcactgtaatgatcagagttttcattattcaattgtttgcatggccaacaggctggcccatgacctttcattcccagcaaagcctaattgcatgaaagtgccacacagtttgaaaacaggctgcattatttacggatccaatcgaattagcttgcaattcccagaccagctttagatcaatgagatgcattgtgtgttctcccacgtgggtaaggaggcctctctgctcctgggcagcccaagacagctctgtagtcagaagatgagtctttgacggcttccaaagcatcgtcttaatgggcacagtaggatgctagaggggatcccccaaatctatttcatttttaaacaaaaaagagtgaatgtttctgcttatgaaattctggaaagttagtcctagccaggaaggggccggaggactccgttgcagaactcctgccttgtggaaatcaggaaaccgagactgagtgaagcagccagttagcggagctggagaaggatgtcccatgtcctgagactgaccccattcttgatcccaagcactgtaaatactgtgctgattaagatttagccactgtcccctgggaatgcactgggaatgagggtcaccaagaggtcacaggcataaaaagaaccttcctgcatattgttatctgtgctctgacagaggcaaaacagggcgctggaaaggaggcagcgtgtttgttttagcttcactcattcatgcgttcacttattcatccgatggtgtatattgagcacctaccttgtgtcaggcccaccctattctaggcattatggacccagagccaacaaggtgggaaaagtcccatctccagctcctcacaccaagtggggcatcagactaattaaccaacacacttaaattgacgttcaggtaccattatagcaaactctagaaagcagtgtaaggtgatgagagaggcaatatcaggaaattctgatgtgatgggaggagtgggaattaactgaacatctgtagatgtggggttgtgggttgggtgggggtccaggcagaaggagcagcaagggccagggctggaaagagcttgtgtgtgagggtttcagggactggtgtggtggggttgtcaaggcctgtcttgtgacgtggttagggatgtgggactgcagcctaagagccatgggaaatctagatggtttctatatttgggcaagggggttggaggatgatcaggggagctctttacaaagagctgctggctgctgggctgtcagggttggggagaatggggggatggtgacaaggtggaagcagagaccaaatttggcccacataaaagatgatgctcataccaagtcaagtctactaatagtaaactaatccaaggatcacaggagacaagccctgccaagtcctccatgcacacagtccctggccatggtcaacaggagacctgtgtagctactgtcattacccagcccgtgcagctctcacaccctgctggacaggtgacgtttatcctctttcaaaactctccaggaagtatcttgtgggaaggtagtgaaatttggcttcaatggcatagtgaggttgcagttctgatgacctaaccgtgaccatgggcaagttatgtaaccaagctgagtcaccaattctttgttcataaagaaaaatttgagtctctctttgcaggtcgagtgctgcaattaaaaagatgcatgtaaagccgggcactgccgagctgttcactaaaccttagtcctccccaaaaccccacctatgtgcagactcctccctcatccctttcacgtgctgaggagtctctgagggtctaactcagtttcctccttttgtccagggctccatgaaaatcaaatttctgctcttaatggcttattatcacttgctcgagtgtgttatgtgggattgtgttacaggaaagagctaaggttgtttgtcttgcaacagatgggataagtaagttagagcttcggtatgtcacccccactgtctatcagcccggctgcttcccaccttcctgtctccattggaggctcatctatctactcccaggcggcttccttctgactcagatggcttcccggcagccgaagcatgattctagaacaccctcttccccccggctctgcttctgtgaacacactcaaccctcaaaacttagcctcagtcttgccttttccaagaaatcttcagtatctacccagaaatcatctggatgaggaacagtgttttataaacactggactaagatatcccagcctggcttcctctgagcatctggcccgcttaaaatatgtatgtgggacaagcagctgtgtggctgaagccttggtccatgtctaaggggcagacttccgtgttagttaccccaatacgcccactctctgcttcagtgagcaagctctctgcactcgcctgcttacccactcactcagcaacacctgcagctgcctggccgacctgggtggggctggggacgctgaggtgggaaacgggtgtcgctgtgctcgtgggttgtcatcccggtggtggtgtccgaaatccagggcgagggccacccaaactgttcccttaaagaaccacatgggccctgtgtccttaagccccagggctaatgtcatcccaagcccttctgccctgcagagctttccgcccttttcaagggcttcccccgccagccccttttctcctactctgtccccggggatgtttttctcttactgactctctcccctcagcagcacccccagcacccaccaatcttccctgatctgagccagtcctgacatatacaccacagaacgtcccgtgctggatcggcttcctaaatccccttgggggaatcaaaagaagaaaagtaacaaatctggagaactattactatttcatgactcaaaagaaacaagaaaagtatggagtcaaactgaagcatacattcaatacacatttttccaggttttaatcatttcattcattaaaccccgtacatgagcgcacccacgcaaggagctgatggacacagaggcacgccgtccagccctcctgcgaccccgcacttgtcagccaggaatgtcctggcacacctgcagtttcgaggtcccctgggggagcagcatggaatcagtttctggcaaagccaaggccacagccgcagggtttgccttgggagatggtgagagggactgtagccagagctctcacttggcattttgtgtgccttcatccttacagctcttgtcttcatacgagggcagctggagcctgttgtgagcagtgcaggactcgcggccaggctccctgagttctgatcctgcctcttccccttgttcactgtggcgtgaggcaaatcccttccactcatggggcttctgtgtcctcatctgtaaacaggtgtgcagacaatgatgccagcctcacaggagtgttatgaggattgaaacagtaggtacacagctcctagaacagcacctggcactagaaatgtttgatcatcagtgggggaatcaaagctcagagaggtgaagctactagcccaaagtcacacagcaagaaagaagcaggatgacacgtgagccaagccccctctgccacactagctctggaggccattggctctcaggtgatgggttttctttgtacctggacatgggggtcaggaaagctccagtgtagctgctgacctttgacctgaaggaatctgggatctctcagatggggagtccaccatcagtctcagcaaaaacactaccaatcaaccagtccatcgctgatgtctgaaactctctggtgcaggacgtttcaccctttctggttttgtcgagttggccccctcctggtagagcactgccaccccgcaggtttccaagggccaagtcctggtagtactgacagttgaccagctaagctgcatcctaggcacccaggctgggctcgggctgctgtgtcaccaaaatccctggtctttgtaccattgggtacaaagaacacttctcaacagaagtggagcgaagtcctctttgcctcgacccttggcctggtgccaggccttctgttcactctcagatcagggatgctctggcctcctgggggactaagatgttcaggagctcatcctgggccacccacaggcatcccagctcctctcaatgctggttgcttggcactgagccataattgaacgattccagacttcaccttctgcatctcgaaggtggaataagggcaatgaaccccacctcatgggctggctgaagggatacctgcatggatcctgggtgtgatgcttaatttcaggtgcctgaattaaagaatccctagaaagctggtcaagcctcactttggggtgtgtctgtgacggcgtttctggaggagactggtgtgggagtctgtggactgaagggagcagatctgccctccagtggggggcaggcaccatccattgactggtggtctagatcaaacaaaatgggcagaaaaaaaggcatttcttttgtttgtttgttttgttttgttttgtttctctgtctgtctctctcctggagctgggatactcttcttctcctgctcttgaaggtcagaactccgagctccctgacctttggactttaggacttgcaccagcgtcccatccactgctctggttctcaggcctttggcgtcagactgagaattaccattggctttcctggtgctgaagcttctggatttggactgagccgtgctgccagaatcccagggtctccagcttgcagatggcctgtcaagggacttctcagcctccataatcatgtgagccaattccataataaatcccatccatccatccatccatccatctagctagttagctgtccacgtcctgtgtatataaacagattataacacgttttctgtctccctggagaaccctgagtaaactacacttgagaaggcccagttccacccctttgggcttcggttccatcacttgcaaattgtgtgaccccatacacatttccgtaaacctgagcctcagtttcctcatttgtgaaattgaccaaaaaaaaagaataactaagtcccagactttgggtcaagatgaaaagagatagtgtacgaaatgtctgatcacagtgctgaaagcgcatatcacagagtaaaattcaaccaatccataaggccatcgctcttccataacattgtggctgtgctgctattgggtgtttacgctacacacacaattccatgtggtggtttcaatattctctttaccctttgttgtcctgctttttccagtttccattccagtgtatttttcctcaacattagcatcattttacatggctgtttaacattctatcttttactcggccatatttcatttaaccagtcggtcatttgggttttctccctttttccaatactacacacagctctgtagtgagcacgtatgggtaaatcattcctccatcatccagattctatccttagcacagatttcaagaaatggaattattgtatcaaaaggcaatgcacagaaacaacaggcggtgcatgcttttaaatctcttgatgcgtattgatctttcatgttccaaaaaggattctagtccgggatttccaccctggtaagtatcaggaggctgtgtggcccaccgctcctccttgggcttgctaaggagcaagcggggcctctagacttaattgttaagcattctcaaatcctgctgcacaaccttgttcagaaatactgcctttgagtcattcactcatttatttagtcattcaatgcttaattcccaatcctcagcctactcagccatctttctttttaatagccttgttgaagtgtgatttatgtaccataaaatgcactcattttaagagtacaatttaacggtttttagtaccctcacagcagtatgcaaccatgatgacaatctaattttggagcattgtcatcatctcaaaatgagacctcagcccctggccaccactgaactgtgttctgcctctctagattacggacttgccttttcggaacatttcataaaaatgggatcatacggtacggtatatgaccttttgtatctggcttctctcacttagtgtcatgtttttgatgttcatcctgtcgcattagccttcttctgggcaaacctttttctcctggcctcctcgacacagtgctctttacattttctctacttcctcagttgctcctcccagagctgagactggggtgaagtgactgaggcagttgtctgggaatcaaaattaaagagaatactgaaaactcagtcatcaaggtaaataataattaatccaacagtttaaaaaataaaatgaatgaaaaaaacctaactttatcacaaacaaaatgtcaacattttaaataaaggcaggggctgggcacagtggctcacacctgtaatcccagcactatggaaggccaaggtgggcagatcacttgaggtcaggagttcaagaccagcctgagcgacatggtgaaaccctgtctccactaaaaacacacaaaaaattagccaggcgggtagcgcatgcctgtaatctcagctactcgggaggctgaggcacgagaatcgctagaacctgggaggtgaaggttgcagtgagctgagacggcaccactgcactccagcctgggtgacagaatgagactctgtctcaaaaataaataaataataaataaataaataaaggcaggacccacggtagctgtgataaggaggaggtgagtgaggtgagtctggcaggaagagagttggccttgagacaaggtgtccccatcacactgtctggaaaatggtcctgagcactctgggcctctttcttgctttgatttttctccctaagactttctgcatttgtgagtcccttacatagtatgtgtatatttgtgaagtgtgtgtgaggggtgatgcctttaaaaaaattagtccaggccaggtgcagtggctcacgcctgtaatcccagtgctttgagaggccgaggcgggcggatcacttgaggtcaaggagttcaagaccagcctggccaacatggtgaaacccagtctctactaaaaatgcaaaaattagtggatatggtggcaggcacctgtaatccaagctactagcgaggctgaggcaggagaatcacttaaacccaggagatggaagttgcagtgagccgagatagcaccactgcactccagcctgggtgacagagtaagactctgtctcaaaaaaaaaaaaaaaaaaaaaaaaaaattagttcagacaagtgggtacagccaggccacggaacaaagtgttcctctatcacttggattcttccattaaaatagatttcaatcaatggaactactgtgtcaaattcaaggcaaaagaactaaatgcaatggacattttaaagtcgcttgatggatcttgatgttttacaccaaggttttacgcaatgacatggagcatgtctgcttcacatcccgggagagcctcggacggcaagctaaggatcccgaacttgattcttaggcatggagggcttttaggcaaagagcaccaaggtccctcagtcactgtcaaacactcattcacacaaaacagagatggcagcacactagagcaggatcaacatttttcttaaagggctaggtggctaaatagtctcatctaagctagccatggaatttctgttgctctcacaactctgccgttctagtgtagaagcagccgtagacaatggttaaacagatgtgcatgattgtgttccagtaaagctttattttaaaaagcaaggagctggcccagttggcatgtgagtcaaagtttgctaccctgctctagagtgttcatgtgagctcaatgaatctccgacttcatgcttgttgcagaaatggacctggaatgtcccttaacagttttcagtagaactgccttactcagaacttttctctgacagtgtaagtgccgcacacacttaacagtgcccagtggagcaccctcatgcacatgcagtgtgagccttttggaagctggtggagggccagtgcatggaggagggaatgaatgaatgtccatctgtgctcaacagcagatagtgcaagatgggacgtgaagggccagaggaaactggaaggtatgcaaaagccatttccaacaaaacctgtagtttcccatgaagtgaacacttcttttcccccacctcctcgtcctccgctattctctatcttcatgaacaataacatcaaacacctccctcctgcttatgctaggtgacgcctaaataacttgcctcatcctcctcgctgccttccttctcctggatccccacattcagggggttctatctctgaagatggttctaacttggtcccctccatccccactgtcatcctcctggtccaagcccttgtcttctccagcaggctggacatcagcctgctgactggtctcaccatggcccatctccactctccagtccaattctctacagcatccctggagtcatctttctcaaaagcaggcagtgtcattgcttctctgctccaaacccttagatggcttttagttgctcagttctagattaagccttcacttaaagaaagaaagaagaaaggaagggaggagggaattgcaagcatctgcaatgagcgccagttccagggcagcactgtgccagtgacatctcctctgcacccacctgcccctggcacatgacctgcagagacaccaccggctcccagcatagagagctccactttgcccacacaccttgccctgctcccgtcgttgccttggcattcaacattcccccaaccaggagcacccttgcctgttttcttggcctgaccaattcctactcacattttagggttttcctccagttcgaatcttcctctgcatctccttcaggaagagttttcatgcccctctggagtccagaatgtttaattccagtgcctggtgccagccctagagccaac

SEQ ID NO: 317 - DNA, 195267 bp, Homo sapiens
ttagattagtacaggtttacttttaaatatttaataatataaaagacttgcatagcttcaattcatttaagcttcccaataatgggtaaattttaagtttcctgaaaagtgagatcatccatgtagacaatcctgtttttgacataattgtccaacgtggaggaggaaacttgttaaggccttccatttatcttaccatcagtgacagctgagtcgattttctcttctggtgggtatgctttgttccttttggaaaatgcctggctgatttctgcataggttctgtttttggtctcaggcagcacaaaatacaggtagatagcacctgtgatacaaattgtagcaaagactaggaaacagtaggtgtccagacttttctgtggaaaggcagagacaaaaaccctcaaatagataatcagtaaacttgctgttaaaccatctctacacagatttttaagatagctccacattcatataccaatactcctagacaaaacaccatgtgtgatgctggctcaataaggcaagtgtaccctacatgaagtgttatcacataaggcttgaataaatcagcttcaaactctgggaaagatgagaaaatggcacttttttgttgttgttgttgcaaatttggcatttaaaaattaatcatcacgaaagcaaaatggaatgcttgctgaatattagcttaagcttatatttacaattaaccacattgtcttcttgcttctactatacacatgagacaagaatgacatcaaaagggaagagaaatgccttagttcataggaagaatgtggagcacagaataggccaaggtaatgccagttttttctaatatgcaaatgatctaactcactaattgatactctgaggcggccttgcacaaataagagagatcagaaaaaatagaaatgctcaatgcaatcactccgttttatgtatcctgattagtgtttggactagaataaccctgccaactgcactagaccttgagcttctcagtgactcagtcacctctgtagctcctgtgccttataggaggtactcaggacatatttgtggaataaaagacttgaaatcctagcctcaatcaatctgcttgctttggtctcccaggtactgggattataggcatgagccaccattccagaaataaaagactttctgggtcccagctgtcaggattgtgactattatatgcaacaaacatctactgatccaaagataaggtgacactgtctttgaataatatttcccaagaagcaatatccagattttagtcaattccattctattctttgatttgacaaacatttatttttggagaatggcaaagtgcttaagcttgatccctggatcacatcctagatctaccatttactaaatctgagactctttgtccctcagtttccatgattgaaaaagaggataatcatggtacatgtagggttgttgtatgaattaaatgagacattccctttaaagtgccacatgcagtaaatgttccacacctgggggtgcttagctcttgagactgtgccttctgctcgtacaaagacttcaagagtagtgtggagaagggggagagtatgggctctgaagccagtcgagtgggattcaaatcctgatcccattactcacatgttgttctaacacttatgatgtgccatttaagatagaatttcaatccactgagcatctgtttcctcatttgcaacatggtgatatatacccacacattgttttgaagatgaaatgagatatatcaattttgcattcaacatcctccacacccccatctgcaggcggaatggacatctgacttatcaagtccaaagtggagcctctaaaactgcctgctctagccttcctcatctctgctgatggcacctccatccttctgattgattatgccaacaaaaacacttggaggcaggctgagcttctctctctctctcccacccacatctgctccatcaggaaatcatgttgctccaccttgaaatgtattccaaatctgagggtttgtcatcacttctattgtaacctaattttggtgcaagccaccatcatgttttgcttggatttttgcaatagcttgtcaactgatttccctgcttttcactttaagcataatcttaagattattcttaacagacaagccagagtgatcctgttaaacaaaggacaaaacttgtcactcctctgctcaaaacccaccatgacttcctaagtcacctgcaggaaagccaaagtcctcaccatggcctccaaggccaccgaccatgtgtccctcttatttctctgatcttactctcctcactttctttgccccaactccactgcctttatgatttccctccagtattaggcctcagaatctttgcacatgctgttctctcttgctggaataatcttcgtttaggcctctgtatatcctgctttcttactcctcttcatccgacttaaaggtcattttctcagagaggttctcgttgactctcattttgaaatagcccctcccagccctgcttcattgccttcaaaaacactcatcactatgcagcattatagtgtgcaactgcctgtttattaaccttctccctaccaagaggtaactatctgaaggcaggagtcatcatttttcttgtattcccagagcccggagagtctctgatatacagtagatgctctgagtatcttagtgagtggatggatggactgaggctcagagaggcttcctgccgtatcccaggccacaaacagggcttcctaggacctctctgacacccacacagctgcctcttgcttggctttcttttcccaagggacctgatgggtgtcgtgaggattattctcacagtttcacaaaattcagtcaagaacatgtggctcagccgagcacagtagctcacacctgtaatcccagcactttgggaggctgaggtgggtggatcacttgaggtcagaagttcaggaccagcccggccaacattgtgaaaccccatctctactaaaattacaaaaattagctaggcgtggtggcagtcgcctgttatcccagctacttgagagactgaggtaaagattaaaactggaccccctccttacaccttatacaaaaattaactcaagatgcttaaagacttaaatgtaaaacccaaaactataaaaaccctagaagaaaatctaggcaataccattcgggacatagtcacgggcaaagatttcatgacaaaaatgtcaaaaaaaaaaaaaaagaagagcaacaaaagcaaaaattgacgaatgggatctaattaaactaaagagcttctccactgcaaaagaaactatcatcatagtgaacatacaacctacacaatgagagaaagtttttgcaatctatccatctgacagaggtctaatatccagagttcataaggaacttaaacaaatttacaagaaaaaacaacctcattaaaaagtgggcaaaggacacacacagatgcttctcaaaagaagacattcatatggccaaaaaacatatgaaaaaaagctcaacatcactgatcattagagaaaggcaaatcaaaaccacaatgagataccatctcataccagtcaaaatggcgattattaaaaagtcaagaaacaacagatgctggcgagcttgcggagaaaaaggaatgcttctacattgttggtgggagtttaaattagttcaatcattgtgaaaaacagcatggtgattcctcaaagacctagagacagaaatgccatttgtctcagcaatcccattactgggtatctacccaaaggaatgtaaatcattgtattataaagatacatgcatgtgtatatttattgcagcactattcacaacagcaaagatatggaatcaacccaaatgtgcatcaacgatagactggataaagaaaatgtggcacatatacaccatggaatactatgtagccataaaaaggaatgagatcaagtcctttgcagtgacatggatggagctggaagctgttaccctcagaaaactaacacaggaacagaaaaccaaacactgcatgttctcacttataagtgggagctgaacaacgagaacacatggacacattgaggggaacaatactggggcctatcagggggttgtggtggagggagagtgttaggaagaatagctaatggactctgggtttaatattaatacctaggtgattggttgatctgtgtagcaaaccaccacggcatgtgtttacttgtgtaacaaacctgcacatcctgcacatgtaccccaaacttagaataaaagttgaagaaaaacaaaaagctcagaaaaagtttgactagtcctgcccgtctcactctgcttaggcactcaggatatgacccaatattcttcaggttgaaaagaataatttgctcttttccagaatttattgagctcaaactgcattttataacttgagtagaatcaaagaggcatacatttgcatgcaattttctctgaatcggaaaatattggcactccacactggagagtgtttttcgcaggctttataacaaatggcccaagcaacactgatgctgaccacagcaaatgctgccaacaggatcccagagccagagtgtggaggtgagcatgaagggatgtgggctcctccccacaaccacagttgcctcccttctctgttggtgatgagaaggctaaggattttccctgttttacaggtgaggaaacccaggcttggagaggaaacccatgcttgaggagcatgctcagggccctccgctaatacatgggcttcaatacaggcgtgattcgtgccgttgtctgtggctctactggctcagacattttattctgaggaagaagcccaggcttcttaggggtctgtttgggggctggaatacatttgccactgatacttattggaataagtgaaacaatcaagttgtgtgagtagtttctcttggtggctgctgtgggctgaactgcgtccctcctgaaattcatacgttgagtcctaagccctagcacctcaggatgtgattaagttgaaatgaggtcattagggtggggccctaatccaatatcctgctattctcataagagaggagaagaggacacagatcaacacagaagggagaccatgcgaggacacagggagaagacagctgcaaggaacatggttgtgctttggtcaagggtaggctgaggtaaacatccagagtgactcagtgagtttagagggcaggtgtataactctacttgttatcacagccatgtagccataacatgggaagggcatcccttggccctacaccactgttgtctgtaaaaggtataactgccctgctgacactgtacatgcactcttgcgctgccgcccagagaaagagagagaaaaccagagctgtccatctgcaaaatggaaagaggggagccaggacatagcttgagttctggtgcccagagaaagagttaagctgctgaccttgaagggcaagctggcagtgcagccatgtgtgggagctgctggactaagcagccaagacagggtggacagtgtgagagaactagtgtgagtgagcttctcatgagagactacattgcacctgcctacggccccctgagtgttcttccagctgtctgctcatccacccactcccttcggacctcagcatgagctggaacctgaccctggggataacaattggtgtagttgtgaacttgacaacagccattaacaagccaaggagaggggcctcagaagaaatcaaccgtgctaagcccttgagctcagacttctaccttctagaattgtgagacaataaatttctgttgttgaagctccctagtctgtgctatttggtcatggcggcccgaggcccgagtagatgaacacagtagctcttgattgtggctgagctggttttcagaagggaggtaggtcagaaatggttcacgtatggcatctagaacacatacacgttgctcccatgggcgggcgtgagtggggctgtggtgggctggggttgggggatgtgactcagaacttgttagccctgtatttctctaatgcattgatcattgctcacagcagccccctgagcccagctctctaacttgctaagctcctctccggaaaggaaattaaccgtgggtgccttcccaggcttgggtcaggaggctgacatttcacaaaatactaaacgtatctacctgcccagtgtctccatctgtatgtccagcctggctgttcctgctccgatgaaggttcatcaatagtcacacctgcaatgtttcccgaatgacccctgaaaacccagacaccctggacatacccagcttctcaggaactgtttccagaggggatttgtttcgaaaatgcccacaggcataagaaaaggctcataaatgacaggcaagagaagcaagaacaaaacaaagaattgattccagtttttagaaatacaaaaaattatctaggtttggaagtgcagtgaccttggaagttactacatctctctgagctcatccccttgcctgtcaaagggagtgatacaggcactacctcctagcacaggcagcggtggagcactctgggcacacagcaagcattcagtgaacactatactaaagtggcatgttggtgctgttaatgctcaaactgtggcaggcaagcaaggtctttcacaccccacacccctgagtggctcagaagatagtggcctgcttctcggacatacaaatctcagtactgggccatgtgaaggtgctggaacttctctacttaatttataaatgtgatgggggaaccatgttgacagaagcagcttgaagttaacttttgccacaataatgaggattttactgacacctggctctgctggctttgagccaaactgtaaaaagccacttaaggtttaaagtcaattgaaaagatacttgttatgttctgactgcagccacgtgaaggtgtcccaggatgggaataaatgagtgtgggatcttgactaactccatggctcatggagcccccagcagcccttacgtttcagaaatagagtgtttgttgctaaaacacaaagatgtcttgaaagttacagggtgtggcagccttctaactctgagacgaggaggctgtagcaagtgatggatggagagggaagttgagcacaaggtggtgaagtggagaaactgggtttgatgctgactgtgggacctgggctgaccatgtctgcttcctggacctccttgcctgtacagtggcaaggatcagaaactccagctcaggactgtgtgagggtgatgtgggcacagaaagccatgcatgggggagggtgcggcacagagcaactgctccgtaactgtgaatgcaggaacagccaccatgctggggtggctggggcttggagtgccgcaaatactgacctttggctcacccaagctggcagcagaatctctgggatgtgttgggcttggcactagtaaattagcaggcggacttagaactgagtgtccagaatagttggtgaggggaggaagacaggaagacaggattgaaatagctcctgagaatgggtggtgatgtatatgacggattctcacctcctccaggtggtaccacccagcactgagggcagcagggagccctggtgggcatttgagcagggaagcttcatcctccttctgcaaatgcttctgggccccttgctctgtgcagaaggcttgcaaagccttttgtgttcctgctcccagataaccctcttatctgatcctctctctcacccatctttcttgctcactctgtttcagtcatataggcctctgggtggtttcttacacaggccaaatattagccctgcctaagggcccttgcacttgctgtttttctagccaggacttcaccattcccagacagctctgctccctcacttcactcaggcctctgcgcaacggtcacctccttccagagcccttcacgattgccccatttaaaatagcacttatgcctcttttgtttccccgttcagctccagaaccaggaaacacaggctttgttaccactgtatcctcattgcctagaaaagtgcctggcacacagctgggactcaacatatatatgtgttgaattaatgaattcggtttccaatgaacagatcctttccctacccaaaaagacttgtatctgattcttgagtatgtgggcattttcctactgatcactgtcacccttgggacaatgatcccattagctgtggttatgatgatgacaatgaggatgttaaatgggtggtggtttgcagtgtgcactggaactattagatggaatttgtcttacacagtgatgagcacattgtaaaaatgataagtaggttgtaggtttgagttgctaacctaggagtccttgcataccgtcagcaatgggtagcccacaccctctgaaagagcccacagcatttagggaagctctaggaaggcacaggaaagagaaagggatgaaaggttttgcccaaagcatagtttcttccttccttaggaaaatagcatgagtttccagttgagaggagagagatcaacttctgctctatgaatcacccctcaagtgctgcagaatcaaagggaaccccatgggcaaaagactccttgtcagtcatacctgaatgaatgggaagaggagcccaacagcaaagttggagagccagttgacggtgcctgcaatgatgaaggcagccggccgctgagattgctggaagaactcaccagtcaagatgaacgggatgccacctgcagtgtgtgagccaggacatggaattaatcactctgagaaggtcatgcctccagcatccatctccatctgccacactttagaacccccccacccctgccccttgactggatgtgtagtgggccccagttcctgagtcgccctggtggcattgcagtgggacaagtctttattttgagagactgtcctgtgcaattgcagggcatttattaccctttactttctgatgccaggagagcctccagtcaccaccacaacccaagccaaccctacacatttccaaactcacatgtggtctcaggtctatacccttcctttcctccatatcctgtacagtgagaccagtgatcacgccctgtgcccagaccaggacctagggctcagcatgactgctgggatcccacttgaacctccccatctccagctggagtcaccactctgccaatgagatctacacctgggtgtttctcagacaagacagagtgggtaatggatgggaaatccctcagggacttttactaaactctagagagacagtgaacacaatttggaaattactaggctggaggcattcattgtgtcaacatccaacaattatttatgtgctggggctgttccaacagtgaggtcaaaagcaacatgtccttgctttcatgcggaacccttgtctgctgggatgacttgttcattaaaatgggagtgagtccaggaatggaaaaccaaacatcgtatgttgtcactcaaaagtgagagctaagctacgaggatgcaaaggcataagaatgatacaactggggccaggcgcggtggctcacacctgtaatcccagcactttgggaggcagaggccagtggattacatgaggtcaggagtttgagaccagcctgactaacatggtgaaaccccatctctactaaaaatacaaaaattagctgggcgtggtggtgcatgcttgttatcccggctactcgagaggctgaggcaggagaatcatttgaacctggaaggtggaggttgcagtgagccgagatcaagcatattgcacaccagcctgggcaacaagagtgaaactccctctcaaaaaaaaaaaaaaaaaaaaaaagataaaagaatgatacaacagactttgggaactcgggggaaagggtgggaggggggtgagttataaaacactacaaattgggtgaatgtatactgcttgggtgatgggtgcatcaaaatctcggaaatcaccaccaaaaaacttattcatgtaaccaaacaccacctgttccccaaaaaacctatggaaataaaaaaataaaaataaaaaaggggagtgagcaaatgaataaatacatataaatacaaaatgtgataagcattctggaggagatgcactgtctattttggcagtgggtggagaaggatgctctggggaggagatggtggagatgtggattgaagacgggaaggtggctcctgaagatctggggaagatcatgccgagtggagggaggggccagcagaggtcctacaggtgaaaggattgggccaaagtctacaacaggggccaatctgtccagacacctgaaggaggcagagaggaatggggtgaggtagcaaatgtgagcagggccaatgaagcagcctcttgtagatcatggagaggggtttgcagttgaagaaaaccactttgggctgctatgcagcagttgaggtgatcaatttgcatttcacagaggtcactgctctttggagaaaagcctggagggtgtaggagaggatgcagcaggctgttggggcagtccagggaggaggcaatggttgtttaggggggctcagatcacggcaggtgagatgaaaggaagggtctgaatttggagacaattgctccattgaggtaaagctttcaaggtaagcattgcacatacacaatcacttagcaagccgacccaaccaagcagcccagggtgacaaagccacaaagccaaggccaactcaagtctgaatctctccagacctttcaccgttatcaccccactatgatgccagcaaggcttgcactccaacaaatcaaaaacaactcggaatggagcgtcccctcacctcccactacactgtgagcccctctgatcaggcactatctccatttgtctggcatttcccacagagtagatactccatcaatatttacttacataagttaaatgctcaaaagttgattttgacaagatttgatatgctgttcactacaaaaatattagactctatatcttaaaggtatctattgaactgtgtgagaataatggttacacactgaaatgtaatgaaaccagcctttggttctgcaaaatatttcattgtcagaaagtgtttgtgtcacacactcagttggtcctgcagctaacaccactgggaatcagttcacagcaattctgaagcctgaacagggttaggtgatgatgtttcactttctgtgtctttcctaggtgtgtttttggaagcacctgtggataactcagtacttctgaggctggtacaatggaatgcggtacatcaatgtacaatgcagtagaacactgacaaattgcctcctggtacatctctttgtttcttcagggcttgaggccatgacttgtttattggttaagactcctgatcctagcacagtgctgaacacataccaggtgctctgtaagtgtttgcaggattgatgaaagaacaaataattaggatgccagggaattcatggtacattgatatcagatcctctctttcactaggccttcagaccaagccctaagcaaccatgaggagcctgcacagctccactgtacacaggtgtgttcactcccattatctcccttgatcttcccaaccagagaaggtggtaaagcatagtggactggagcttgggctttggtgttagtaagatcaggtttaagtcctatctcagctaaatctttctagaacggaattctctcacctgtaaagtgagtaggagcttgctactggggatatttgtgagcatgaaatgaactactaaatgcaaacacttaatataagtcttgtacatgaagggcactcaataggtgttagatactataataataataatcaagactcctctccattatatcccccattttatgatgagttagctgaagctaagagaaggggagtaatatatgcaaggtttcttagcaagaagtgatggtgatgaagaagatgatgatggtaatgatgatgacgatggtgcttctgtagctgctggtgaagatgatgatggtaactgtggcaggcattatgaaaagcattttacaaggtctctacaaggagaactacaaaccactgcttaaagaaatcatagatggcacaaacaaatggaaaaacattccatgctcattgataaaaagaactaatattgttaaaattgcccacagcaatttatgaattcaatgttattcccattaaactaccattgacattcttcacagagccataaaaaaccgttttaaaattcatgtggaaccaaaaaagagactgaatagccaaggcaatgctaagcaaaaagaacaaagctgggggcatcatactacctgacttaaaacaatactacagaattatagtaaccaaaacagcatggtactggtacaagaacacatatatagaccaatggaacaaaatagagaacccagaaataagactgtgcacctacaactatctgatctttgacacacctgacaaaaacaagcaatggggaaaggactgtattcaataaatgttgttgggataaatggctagccatttgcagaagattgaaactggactcctcccttacaccatatacaaaaatacactcaagatggattaaatacttaaatgtaaaacccaaaactatagaaaccctggaagacaacctaggcaataccattcggcaaataggcacaggcaaagatttcatgacgagaacaccaaaagcaattgcaacaaaagcaaaaattgacaaatgggatccaattaaactaaagagcttttgcacaacaaaagaaactatcaacagagtaaacagacaacctatagaatgggagaaatttttgcaaactatgcatctgacaaagatccagcatctatatgaaacttaaacaaatttacaagaataaaacccattaaaaagcaggcaaaggacatgaacacttttcaaaagaagacatacatgtggttaaaaatcatatgaagaaaagctcaatatcactgatcattagagaaatgtaaatcaaaaccacaatgagataccatctcacaacagtcataatgcctattactaaaaactaaaaaaataacagatactggctgggttgtggagaaaaaggaacatttatacactgttcgtgggagtgtaaattagttcaaccattatggaagacagtgtggccgttcctcaaagacctaaagacagaactactattcgacccagcaatctcattaccaggtatatacccaaaggaatacaaatacaaagatacatgcatgtgtatgttcattgcagcattattcacaataggaaagacatggaatcatcctagatgcccatcaatgatagactggataaagaaaatgtggtatatatacactatggaatactatgcagccataaaaaaagaatgagatcatgtcctttgcagggacatggatggaactggaggccattatcctagcaaactaaatgcaggaacagaaaaccaaatattacattttctcacttataaatgggagctaaatgatgagaacaaatggacacatagagcggaacaacacacactggggcttactggagggtgggaaaacagagaggatcaggaaaaatattaataacaaataggtactaggcttggtacctgggtgatgaaataatctgcataacaaacccttatgaaacacatttacctatgtaacaaacctgcacatgtaccccgaacttaaaaataaaagtttaaaaaagcactttacatatattatcttatttaattatcactatgatatgatagttactgctattatttttccatttactatacaaagaaacttaggcttgtggaaggtaagtaattttttcaagagcacatcaccagtaagctgcaaactcagtgactctgggtaactccacagcatgagttttaactactcccttgggccccaagcaagtctaagatactaacaaaacttaaaatacttgaaaagaacttagctatcttcatagttttatctgaatgctctcccaaaccctgcaattcatttatctctcttactgaaggccttggtggcctgatttcctaagagtcttttaaggtctctttcttccaatccaaggtaaaatgagaaagaatggggtttgataaagaaacagaatgcatttcaggcaggccttcttttatttttattttgtttttaagaatgaaaatagttttattgtttttttctgactttcatgaataatatttgctcatgtaaaataattttttaaagcatgcaacatgacaaagtataaaaaggaaacaaaaattacctctaagccttccacctagagatgatctccatttgtattttggtatttagctttgatgttaaatgttctgtgaagaagattggggctacttgggatatttgtcttttaggtgtttgcctttttctacctagaaccctgaggaaattgttctttatctttgaaattcattaactatgatgtttttggttgtattagtccatttttgcactgctataaagatatacctgacactgagtaatttataaagaataaagatttaattgactcagagttccaaatggctgcggaggcctcaggaaacttacaatcgtggaggaaggcaaaggggaagcaagacacgtcttaccatatcaaaagaggacaaagagagaaagcaggggaaacttccactttgaaaccattagatcttgtgagaactccctctctatcacaagaacagcatgggggaactactcccatgattcaatcacctcctacaagtccctcccctgacatgtggggattacaattcgagatgagatttgggtagggacacagaaccaaatcatattctggtgttgattttcctatagcaactttttgtagaacatagcatatccctttgagctgcagatccactcttcatttacttcttatgttatacctttgaaaatgtcttattttctacatgttggattctttgctttagagacacccattatccttgtgttggatcagctttgtttccctttcctattggccatctcgtgagcgactttgttctcttgttttctgcatagatattgtatgctctgggaaatctctctcttccttcttctctccctttctttcctttcttctttgttctagtttcccaggttggctctttccctgtgcattgtcctccatttctcttatccttattgcagtgagctactttgtccagattgccacctgctgtgatatgatggaagaccgatctttgacaccttttctttttatcttctagtttatcttggctttcacatcacagtttgagatctgagtactaactttcagtaagttttcaataaattatgggaaaatgtggcaggggtggggtgggtagaaaaattggttaggggtgtcagcagccctttatggaggatctgggttcttctctctctcttcttagattttgtaaagtgacatgcaccggaacccattccatgttgtcaggggcatattctactccagtggcctttaactggtttcctcaaattaggacatagtcttaggaagtggcaatccccaggaccctttgagagggctgtttggggggaaggtatcttcttgatctttctctgcaattgctgactcacctgctcactctgtctcccccataaaatcaaggtggtagcaagagttcttagggttcataaaatctccttctctggtcagtgctgttttctaaagagtggagacagaatctcctatgctagaattatcctttattggctgctagttttctaggtatgtgatatatttccttgtttggttactgctggccattttttttcaatctgtgtaaaggtttgctttgttggtattgttattgattttaacgactcttttcctgctcattttcttaggtatttgcaggaggaaggttctgtaacaagtctatacatgaccatatttacctaaaatcccttgattattagcttttcaaaggtaagttattggtatttcttgtggtaggtgtgtaggtgctgctcatctgaaaatcatatgcttcaaaattaaagagcaggtgaaaacaatcccttcttacaaaggattttgccaagagagtgccttctttaaaattctgtggtttgcgacctttacttttgtggacttttttattcataaaaatacttggcacaccttatctcatcaaatctttcttcatgaccaaactatgaattatgaattgtaattacagattcggaaactgaaatttcagggaatagagggccttgcccagttactagtcctgcttgtgactggaagagataggacatgaagttgggtcttctgaccatgtccttttgatggcacctctcatttcaaaagaacagaaagatggggaaggtgtcatgtctgtatccaatgtgtcttgcacagggtactcttcatatcacagtactcaatatatgttgcccaacagtccaatatagcttaaactttgaaaattagccccaaataattatgtatgtgggtccactcatcttgttatcttattagagtcttctttgctatcttgtttgagtatcctattctggattgccccagaagcagaccctgagaagcagtttatgtgccagttgatcccaggaaatgcagggaagagtgcagggaggtgaaagaggtggataagggctatgttattagcaacaccaccatgggaagtcacatcttaatccaactgggaccctcgggaaactgtggaaaacacatctcagagttacccagtctgaggggtaggagggctggattatttatccaccatgtctcatcagtcactcattgagtgttatactttgagcagtgcttttggcctgccacaatgtgggctgagagagctggggaagtcctcaagcaaaaagccacatacgggagcagttgtaggtctgtctgagaatcacaaaggggtgtggacaaagggatttggggaagataacaagaatctttgctatgccatctattccttaagtgtttaacttctcattgactattgcaataatcaggtagccattactaataacaacagtgaagaaaatgtttatatcatatacacctaagtactagtttcaggagttggggtataacactagcattaagaacatggggtggaggtcccacactctaattaggagcatggagtgggggtcttatgctaaagttaggggcctggggtgagggtgtaacactatagttaggggcctgggtgggggtctgatactatagtttggagcatgctgcttgaatcagaccatctgggttagagtcttggctctgccacttgcaggctctatgtgaccttgggcacattagttcacctttctggctcgactttcctcctctgtaaagcaaggacaatggaattgattttatggggtcattgcaaagcttaaaggacctaatgcagagaatacacattgaattgtgtctgaggtgtgatgaacactcaatagcttttaatgatgattattattattcagaagaagcatgttccaggagaatattcatcctgtgatctgagtaagcttcctggctcctggatcccatggacactgagccacacttgttgactaactgtttttcctgagtgggtggtttgcccaccaatttgctttggcagaaaaggccttccccaataacatatagtggctcttgccttagtagcacatgcactgtggaaaaggaaaccagatttgaatccatgcatttgaggcatagaatcctatgatactgcctaggactctaggtaaaataaaaactcttattttacagattaggaaaatgaagctcagagagggaaatgtatttgctcaaggtaatgaaacttggtggaagagccagatttagtaaaaaaaaaataataataaaaaaaaaaaaaagtccttctgactcctttctttacagaataacaagaggtgatatggattgaggtatatgtccctcaccttgaatttattttattcccctctttctttctctccatctctccttcccccactcatttttctcccttcttgccaggaaaatagaaaatacgtgctgattaattgagtattctatgtaaagaattgccaagtaatttaaaaaattctgtagatatcctaaaaatattcctaataattttgagacattatctacttcattagtaatgccattatttttccttcagaaatgttcataagcaaagaaatattcttccccctcattggtaaattcctaatagttatacttagttatgttcaagtgaaaaggaattgaattatgcacgttcttcatatgagacttactttttgaaaactgacttttcctccagatctctgttctctgtgaatctgtgctacagctcagctggtctaacaaccaagctgtcttgtggcgacagcgccctggtgtctacagtgaggaacaatctgctacctttctttctccagagataaacctgatataaattcccatcactttacctactagctatgtgaccacatgtatctatggttctcagttttctcatctataaaatgaagataacaatagttcctacttagttttgttttatgcattaaatgagactgtgcttagcaatgcacacctgtggtatttctgtaaagccagctttgttatttctgcttccagcaatgtttcctacatattatctttaggccctttctccctcctctctattttctaactcttgcccacgtaccctagaaaaagttcaatttttttttttgagacagagtctcgctctgttgtccaggctggagtgcagtggcgcaatctcggctcactgcaagctccacctcctgggttcatgccattctcctgcctcagcctcctgagtagctgggactacaggtgcccgccaccacacatggataattttttgtatttttagtagagatggggtttcaccgtgttagccaggatggtcttgatctcctgacctcgtgatccgcctgcctcggccccccaaagtgctgagattacaggcgtgagccaccacgcccagccaaaagttcaattttaattttatttttgaataaaagaaataaaggacaactgcccaagcttttccttaattcatatttattaaaattattccaatggaaccacgatcatcaatttcttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgaccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccctgatcatcaatttctaaagcccttcaaaatgcctataaacccccttagaaatttccttaagtgtatccatatgtcacttaatcctttaaataaattttccgttaagcaccatgtttaaaaatagctcttttcttttattgaaatacagtcattttgaaaactcttcacgggcattctgttttgtttatgtaaatagacttaatcttgttcatccattcgttcatccatttccatccgacatttacatgtcaagtcctgtgctaggcaattgcagactctactagttgatgtaagaactatcttgggaggcagttattctaactccatttaacggtgaagaagttgcgacccagagtagagagtgacttgctcaaggtggcacgagcagtaaatgatagacttggctccgaatccaagagatccggacccaggtaagagactctctcctctgccctttctctaggagagacatttgagaatttgaaaatgcacaggctcccaaacagatgtgttccatgacaacagccaagatatatcagcaaatagaactcatgccctgcagcatgttggaaagggtgggactggagtgcacacaggaagctcctcccctcacaggatgtatgccaggtctgtcctctcatttctgagaggagcttagacacccacctgctcaggcatgtgcttcctaggtagggaggcaggggaggctgctgagcaactagggatgaggaggtatagcagatgcttcctggggtctccttgcagagccttgactcaccctgactctcagtgggctcctctggctctgctgaccaccaggtgagaggctttggtccttctctagacctcagtttccttgcctataatctcatttaatgagctatttaaaatctcagtaaagtcgaaaccttgatagtgcttacttggcacatggcaaattattaccatgtggaggtagccaggctagtagctaagaccattggcactaactcttgcccaagtaaccagagaaagctcaattgtaatttcatttttacataaaagaaataaagtgcacacccaaacttttccttaattcatatttattaaaattattccagtggaaccactatcatcaatttctaaagcccccccaaatgcctagaaatctccttaaaaatctccacaagtgtgtccatatgtcacttaatcctttagatatattttctcttagtcaccaggtttaacccagtttaaattcccacctctccacttccaagctgtgtaaccacaggtaagtcgtatctctggctctccattttcttgtacataaaatgaggacagaacaggagttcctgcctcttaggtctgtactggggattaaatgagataatgcttagcaacatgtttaatgtgtggctgtattagtccgttttcacactgctgtgaagaactacctgagactgggtaatttatgaagaaaagaggcttaattgacttacagttctgcacggctggagaagcctgaggaaacttatgatcatggtggaaagggaaggggaagcaagtatatcttactgtggtggagcaggggagagaaagtgaaggcggagatgtcatacacttttaaaccatcagatctcatgagaactcactcactatcatgagaacagcataaaagaaaccacctccgtgatccaatcacctccaaccaggtccctcccctgacacatgggaattacaatttgacatgagatttgggtgggcacacagagccaaaccatattggcaaaggcccaatcaatatcaatgattacggcgattcctcttctgcctgtcattaatcccctcagtgtttgctgggaacggactacgtgccaggaacccatgctggggcatcaatggtggcagaaagctgattcaacttctgccttcaaggagccgtcagcatctgaggtccactgagtcaagaaaaccagccctgagcacaagattaacgttctccttcattgggcagtaataataaaaatagttaaaatttattgagcactttctatgtgttcttgaaaggttttccctttgtagggtttctaattattttagaaaaggagtgataaaatgtcatcagatatggcatcagacattgttgatcttgggcaaggaagatcaaattatcaggagtcactggtctgaactgaaagagcaaaggaattttcctcctgttgtatccagagacactgcaaaagttagaggcagaaaatatcttagggaccccctaggccagccccaacccaatatttcaggtggggaaactgaggctagagaggtggagtgagactcccagtgtttcagaggagtaggatccaggacttccaaactagcctgattgactgctctactgtgtcctccctaggaattcctggtgcccacccatgcttagactgttcccactgctggaaatgcccccgagctttggaaagatttcaaggcacacaaggatatgggtaatttacttcacatgagcttggctcccagtataggataaagaagcaatggcgcctttttccccttctacacagcccaaccaggtagccagcataagtaactacacaagcctgtggtctcaccacatgggatgtgttttctaaaaaaaaaaaaaaaaaatggaaaggagacttctccaggaatgggcatgagacatgagcatgtattaattaggcaaaaggggcaggtccctccaccactaccttattctcgatcacagcctcatgtttatttatttccatggattgcatcatcatctttgcatttatcttttgcttgttcattgtgctcctcgagggcaggcatcttgtctctttttctccctgttgcttgccccatagccaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccggctaattttgtatttttagtaaagccggggtttctgcatgttggtcaggctggtctcaatctcctgaccttgtgatccgcctgcctcggcctcccgaagtgctgggattacaggcgtgagccaccgtgcctggccagaaattctttatgcagttgaggagatggagggctaaccagggtgcacgttcagtgagagcctgggctgcgatggggaggtgggacaggagaggcatcttgtgaggggccagcaggggtggattctagggtgtctaggaggccatgcttggggcaggagtttgcaggcagaagctgtaggcctgttggagggttttaggaggagaaagacaggatcagatttgtgatttgaaaagtgtccccgatgcagagtgggatatgggtcagcagaaggagggtgtggaggcagactgggacactggttaggaaacagtagttcagaactccagaaacaaaagggaagttgtttgtgaaaagaagttcgtgcctctcagcattgttaacaaccatacatggtgattctaacttgaatttgtgtaggatcagtcatgagacttagattgtttcctgaactctgctctagggaaatgtaaagtggttcttcctcttgactatcaattagcatgttttgacatagactttcttccagtgggatttaaaatctgtgttctttagttgaatcaataggcttgaacattaccatcctggactgtctgggggagaggatgtttttgaagagtctcaggagcaaatgggccatgaaaggccaaattgactgttaattctaattaaaaagaggaagctgctacagcataatgagtgtggacagttaattagcaggtaagaaaacacaattaaagtctctcagaacaaacctacagtgatgtgttctgtttggtggtgagttaagcacactcagatgacctgtttctaagcttggtgaggagtttctgtttcaatagagacggaggtcagcagtcttgctggtaggttctcatgggcgcattttaacattcttcctttttggatgagcatggtgctgggagggggtgttgaaatagaaaagcaagagtgactagataaaagatggtcgagctaggaggaacatctcccaccgagagaccgggacatcaggaagactggcacactcaagccacatcttcagagagaaggcattgagagtggatagagggaggatacagatgctgggctgaagcagggaagtctgggaaccctgcacggggctgctgagcaatgggacttgtttcctggcccccagcgactcctggggaagggatgagttgaacaggtgaggaatggcccgctctcaccatggacctccagaatcctagcagcaggataccccacaacccccacagacacttgagacgacagggagaactgcttagacaggtggcaggggcaggactccagcctgtgtgttgcccagagggtttggtgtgggaacatctgcagtgaagcatggccagtgatgcccattccccaaggcttgccatgctcctctaggagtgtgactgtcagacctggacagagcagggtggccttgcctgtgggatgaggccggtacattctgaatgccccccatctgctggactctcttggggccccagcctggttgtgcccagagggcagtatcagatgcccaaccagggtgcttccctgggaccctcttcatggcttctttgccagcagaccatgtcagaccatcgaagaactctagcagactggctcccactggtgtgcaccagctcacccacagcctcccctcaccgcagcctcccttcactggtgcacactcattcgtgccccactcccccaccatcccacatcgctttgctggtgcactgtgagtggaccttgcctccctctcttccagcacatgtgtgtgcattcatcacataatgccaccactgctggcatgtgcgtaccctgctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacttgagcgagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagtagcctcaaagattgtaggatcatcagtcaacacagatgagaaagaaccagtgcaagaactctggcaactcaaaaagccagagtatctttttatctccaaatgaccacactaattccccagcaatggttcttaaccatagtgaaatgactgaaatgacagacatagaattcagaatatggataggaatgaagatcactgagatttgggagagtcaaaacccccaaggaatctaaggaattcaataaaacaatacaggaggtgaaagacgaaatggccattttaagaaaaaaccaaacttatctgatagagctgaaaaactcacttcaagaatgcataatataatcacaagtactagcagcagaatagcctaggatgaagaaaaaatctcagagcttgaagactggttctcagaaataattcagtcaacaaaaataaagaaaaaagaataaaaagaatgaacaaaatctctgagcaatatgagattatgtaaagagagcaaatctatgactcactggtgtctctgaaagcaagggagagaaagcaagcaacttggaaaacatatttgaggatattgtccatgaaaatttccttcaggaaatgcagggaacccctgtgagatactatataagatgaacatccccaagatacatagtccgtcagattctccaaggtcaaaatgaaagaaaaaatgttaaaggcagctagagagaagaggcaggacaccaacaaagtgaaccccgtcaggctaacagtggatgtttcagcagaaaccctataagccagaagatactgggggcctatatccagtattcttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccaccgcgcccggcctccagtattcttaaagaaaagaaattccaatcaagaattttgtagccagtcaaactaagcttcataaacaaaggagaaataagatgcttttcagataagcaagtgctaagggaattcattaccaccagatctgccatataaaagttcctgaagggagtgctaaatttggaaaggaaagaccattactggccactacaaaaacacacttaagtacacagaccagtgacactataaaacaactacacaatcaagtctgcataataaccagttaacaatatgatgacagaatcaaatctgcacataccagtattaaccttgaatgtaaatgggcaaaatgccccaattaaaaggcacagaggccaggtgtggtggctcatgcttgtaatcccagcactttgggaggccaaggtgtgcggatcacttaaggtcagcctggctaacatggtgataccccatttctactaaaatacaaaaattagctggatgtggtggtgtgcacctgtaatcccagctactcaggaggctgaggcaggagaatcacttgaacctgggaggcagagattgcagtgagccgagattgtgccactgcactccagcctgggcaacagagtgaaactccctctcaaaaaaaaaaaaaaaaaaggcacagagtgacaagcttgataaagaagccagacccaactatatgctgtcttcaagacacccatctcacattcagtgacacccgtagactcaaagtaaaaggatagagaaaaatttaccaagcgaatggaaaacagaaaaaaatcagggggttgctattctaatttcagacaaaacagattttaaaccaacaaaaataaataacacaaagaagtgcattacataatgataaatgactcaattcaacaagaatgcctaactatgctagatatatatgtacccaacatggagtacccagattcataaaacaagttcttagagacctacaaggagacataggtaaccacacaataatagcaggagatgtcaacaccccactgacagtatcagacagatgatcagggcagaaaaccagcaaagatatttgggacctgaacttaacactgaccaaatgaacctgacagacatctactgaattctctacccaaaaacaacagaatagacattcttctcatttgcacatactccaaaattgaccacacaattggccataaaacaatattcagcaaattgacaaaaaaataaaattataccaaccacacccttggaacacagtgcaataaaaatagaaatctttactaagaagatcactgaaaaccatacaattacatgaaaattaaacaacatgctcctgaatgacttttgggtgaatgatgaaattaaggcaaaaataaagaaattgattgaaattaatgagaacaaatatataacataccagaatctctgggacacagctaaaacagtgttaaaaaaaaaagttcacagtgctaaatgcccacatcaaaaagttagaaagatctcaaattaacaacctaacatcacacctagaggaattagcaaaccaatcccaaagctagcagaagataagaaataaccaaaatcagagctgaactgaaagaaattgagacacacacacaaaaaatacaaaatatcaatgaattcaagagttgatttttttaaagaataaataagactgataggccactatctaaactaattaaaaaagagagaaaattcaaatacacaatcagaagtgacaaagagacattatcactgaccccacagaaatacaaaaagccctcagagactattatgaacactgagaagaaactgataaattcctggaaatatacaacctcccaagattgaacaaggaagaaactggaaccctgaacagaccaataacaagttctgaaactgaattggcagttaaaagcctaccaaccaggaaaagctcaggaacagatggattcacaactgaattctaccagatgcataaagaagagctggtactattcctaccaaaactattccaaaaaattgagaaggatggaatccccttcaactcatcctatgaggccagcatgatcctgataccaaaacctggcagagacacatacatacacaaaataaaacttcaggccaatatccttgatgaatatagatgcaaaaatcctcaacaaaatcctagcaaaccaaatccagcagcacatccaatagcttatccactatgaggaagtaggctttatccctgggatgtaagattcctttgacatatacaaatcaatagatgtgactcatcacataaacaaaagtaaaaacagaaattacatgatcatgtcaatagatgcagaaacggctctgataaaactaatatcccttcatgttaaaaaccctccacaacttggcattgaaggaacataccccaaaataataacagccatctatgacagacccagagccaacatcatactgagtgggcaaaagctggaaacatcccccttgagaactagaaccagataaggctgcccactcttaccactcctattcaacatagtactggaagtcccaactggaacaatcaggcaagagaaagaaataaaagatgtccaaataggaagagaaaaagtcaaactatctctgtttgcagacaatataattttatacttagaaaaccccatagtctctgccaaaaagcttcgtgatctgataaacaactttaacaaagtttcaagatacaaaattaatgcactaaaaccagtagcatttctgtacaccaacaacatccaagctgagcacaagatcaagaattcagtcccattaacaataaccacacaagcatacaaaataaaattcctaggaatagagctaaccagggaggcgaaagatccctacaatgaaaattacaaaacactgctgaaagaaatcagagatgacacaaacaaatagaaaaacattccatgcttatgataggaaaaatcagtattgttaaaatggtcatagtgcccaaagcaatttacagattcaatgcaattcatgtcaaactatcaatgacatccttcacagaattagaaaaaactattataaaattaatataaaacccaaaaagagcccacatagcccagatcctaagcaaaaagaacaaagcaggagacaacatggtacctgacttcaaactatactacaaggctacagtaaccaaaacagcatggtagtggtacaaaaacagacacatataccaatggaacagaaaagagagtccagaaaaaaggccacctacctacaaccatctgatcttcaacaagctgacaaaaacaagcaatggggaaaggacttcctgtgcaataaatggtgctgggataattggggaactatatgcagaagactgaaactggacctcttccttacacaacgtacaaaaatcaactcaatatggatcaaagacttaaatgtaaaaacctaaatctataaaaaccctggatgaaaacttaggaaatatccattctggacataggccctggcacagattttatgacaaagacgccaaaagccattgcaacaaaaacaaaaattgactaatggaacctaattaaactaaagagcttctgcacagcaaaagaaactataaacagagtaaacatacaacccagagtatgggagaaaatatttgcaaactatgcatctgacaaaggtctaatatccagaacctgtaaggaacttaagcaaatcaacaagcaaaaagcaaataaccccatttaaaaatgggcaaaggacatgaacagacactttttaaaagaagacatacacgcaaccaacaataataataaaaaatgctcaatatcggtaatcattagagaaatgcaaatcaaaaccacaatgagatatcatctcacatcagtcagaatggctattcttaaaaagtaaaaaaataacagatgctggcaaggttgcagagaaaagagaaagcttatatactgttggtgggaatgtgttagttcagccactgtggaagcagtttggcaatttctcgaagaacttaaaacagaaataccatgtgatccagcagtcccattattgggtacacactcaaaggaatataaattgttctaccataaagacagatgcatgtgtatgttcattgcagcaactattcacaatagcaaagacatagagtcaacataaatgcccattaacagtagactggataaagaaaatgtggtacatatacaccatggaatactatgcagccataaaaaagaaaaagatcacgtcttttgcagcaacatggatggagctggaggccattatcctaagtcaactaatatagaaacagaaaaccaaataccacatgttctcaattataagtgggagctaaacattgagcacacatggacacaagggaacaatgacactgtggcctacttgagggtgagggatgggaggagggtgaggactgaaaaaacaggtactatactatgcttattacctgggtgatgaaataatctgtatatcaaactcctgtaacatgcaatttacctatatatcaaacctgcacatgtacccctgaaacgaaaagttaaaaaaagaaaaaagcgttctctgtatgggtgctggagttataaggctgcctgaaatagggtaaaaggatccaggggacatagctcagaacctgggttcccactcattcctgtgatttgaggccatcgcaccctcagtctaggtcttggttttcccagctgcagagcatttgtttgttcattcagtgaacaaaaagtactgagttcctgcttggagggggcgcagggttggatactgaagatagagcccggaaggagccacagtccctgggccagacagtgtctcaaatcctgtgcagttctgttgttctccggctcagaccctggaatgctggggcagatgtggatgactggttctttactccatcttccctcaccatctcaggctgtcccacatccacctgccggctggcatccctggcagaggcttttgttggcttttcacaagccagaagggctgtggaactgacagagcttctctccagggtggactgaagagagctgatgccctaatgcttcctgtgagatgatgcagttgtcttcccccacagtctcccagagttccccagagaatcacactgcaggtgcccacagcaggaacttgccctgaaatgcactccatggctgcctgcctggccctgcctgactcagtgcccactccctcctgatgtctcctgggatcaccccccaaacagactgccttcactggaatctgtgtcttagggtctcttggagaaacacttcccagcttttcaaagtcctgctatcccctccactgaagcctactctggcatgccctttactgaactcctattggtttctaatctacactgccacggtacctaggggaacaaacttattgtcccagctttaaaaataggatgtcccatgtctcagaaaccccttcagagtcagcaaatcagagcagttggtcactctaatagtatcacaatttaattatttcttgattacctaaaagggtttattgtattatgatatggggagaaagaacatactgagttgtaaatggttctgagacactaaattgatctgcatagggaagcactgagtagaaagaggggaggtgaaagatggaaaggtacagaggttcaaatatgaagtagacctgggggcatggagtgggcaggagctggactttggcggtagcttgatactttagcaatgctgaggttaattgatgctgtgaacgcatttcaacattagtgtctttgtgactgtctagggttctctttgttaatggactgatgtttccatgcatgcactttatcaaggctgctatggtggaaaggggtggcatttccatgtttatcagggtttttcctttgcattcccttcattctccctcataaaagtccttgagtgtggcactgtccattttattgatgagtagagacactatgctgtttactttccaaaatcagacattttgagagtgtaaggggggatggtattaatagtcacgtcaggatgtcaggcataatctgagagtgtccccggcaaactactgatgagggcacaaggtaaaaactcttagctaaggtcccacagctagtaaggcagaggcagaggtggaatgatggttaatattgagtgtcaacttgattggattgaaggatgcaaagtattgttcctgggtgtgtccgtgagggtgttgccaaaggagattaacatttgagtcagtggactgggagaggcagacccaccctccatctggttgggcaccatctaatcaggtgccagtgctgctagaataaagcaggcaggagaagatggaagcactgacttgctgagtcttccagccttcatctttctcctgggctggatgcttcctgcccttgaacatcagactccgagctcttcagcttttggactcttggacttacaccagtggtttgccagggactctcgggtctttggccactgactgaagggtgcactgtcggcttccctatttttgaggttttggacttgaactgatccaccactggcttccttgtgcctcaacttgcaaatggtctatcgtgggactttactttgtgatcatgtgagtcaattctccttaataaacttgttttcatatatacatctatcctattagctttgtccctctaaagaaccctattataggtgggatttgaagccaggtctattgggctgtccacggggtcctctccgtcaaggtgaacaccttaaacaaacacatctaccatgtgctgaccacctacagtgtggccttccatgcagagctatattgactggtaagactctttctaggtaggtggtcttatctccaatttacaaatgaggaaactaaggcccagaaagatggattgcctaaagtcattcacctaatttgtggtagagatagaaattgataaatggtttttctcctataccagccatgaggccaagtgagggagcatagagactgaagcccttgttcagattaaaacaggagatcctgagggtgacagaacaggtgaagtgaggtctgctttaagcactctgtgcacaagtgacctcatcagcctttgctactgtttctgacttctcttggaagtttcttccagtgaaaagtgagcttatttttcttttccaggtgtcttcctccaacttgcacagcctgcagctcctattgctgtcacatatattaatgctgatatcaaagcccctgctggaagtcagggagcgcctgctctctttgcagaaccggcagccccaggtgtgctatctttccccagttggctgtgacaagcggcctctgcaaggccgaaccatttccagatccaaaagctgaataccccttggctgcactcagcccccagctcctgagggtgtggagagcaaaaaccttcctgctgagccctgacagctgctcagtctgggcccctttccacagcctggcttcttcctgccaggagaaattcatcttttcacagcagagggagtgagaacagcccgcagttcctgttggatggcacctgctatctctctgccccctgggtagtaccaggcgttctctgtgggaaatgcccttcctcctccttctcctccctccctgtctgcctgaaaaatgactcaactttttcaattcactgcacatcactacctcttccctgccttcgaggctgttggggtcttcctctgttcccacagcccctgcccagccatctggcacagcctcctgcacacagaaggacactacttgtcatccttatggattcatgagtggtgaagcgacagacctggcacagatgaggtactttgtgagggtgttgaacgaagatggggagatgaatggatgggtgtgggaacacatgaacaggagtatttagaaatgaattaacgactgacccagtaaacaaacgaacaggtgaaggaacaagaactgatgagctgaaaccctgccttccccaggacaggactgactttgaacttggcttcaagactcattcatttcgtccctttaggagtgacgttgtccctttcagggccccacctttcccatctagggctggacttcaggccagcctggctcccttgtgcacctcaattgatgggcaactcattcctttttgacagagagtccagttttctgatggagcccaaatatgagtatcgattgtctcccaggcccctgatcagatatcacaaccccgggaagtcctccctgaagcctgaggctggtgcatgcatcttcggagctgcgatcatgaatgctgaatgacacacggggcctttgtaccagctgctcctctgcctggattgctcatgcgcagatgtgtgcgtggctgcctccttcttgtctcctgatctctgctccatgatcaactctgtggagaggccttccctggctaccctaagatagcattttctccatcattctcctcctcattttgcatgacttctcttctgagcacttattgctacacgtattagtctgttctcccattgctataaagaaatacctgagactggtaatttatattaaaaaagaggtttaattggctcacggttccaacaggttgtacaggaagcatgatgctggcatctactcagcttctgcggaggtctcaggaatcttccaatcacggtggaaggcaaaggagaagtgaggtgtctcacatgatggcagcaggaacaaaatagagggtggggaggtaccacacacttttaaacgatgggatctcatcgtttaaaatgatgatagtgagaactcactatcacaaggacagtacaggggggatggtgctaaaccattcatgagaaatccaaccccatgatccaatcacctcccaccatgccccacctccaacactggggattacaattcaacatgagatttggtggggacacaactccaaaccatataattacattatattttcatgtgtttacaataagcctccctcaacagaatgtccattccttgagggcagggattttgtttgtttgttttgctccatgcactgctccaatttctacattatctgccatataggggctcctcttggcatatggggcctctataccaatagtttctggtataggggctcaataaatatggataagtgaatgaatgaatgaatgaatgaatgaatgaatctggctgtgtcctcatccggagagtcttattcatctttgcatcccctgggtctagtatggaaccaagtatgtcgtaggtgcttaaaaactacttgctgaattaatgattaaagtacagacacatctttcacattttgatcaaatccttcctctgcttcaaatctccaatggcttcccatggtattgaaagtaaaattcctgattccttaccacggagttatgagatcttctatcctccggcccctactatccttccaacttcatctctttcctttgctaatatggaacatcataatattccaccccaaaacacgaagaactgttgagctgaaggcatgtaaaaagaagtagatgcaggaaggctctctgccttccctctatttgcctaaaagcaggacatagatttacaaagacaagagatattctgctcccaccctcttctgccagggagaacaaagggtaaccagtgaagacaactttggatgcttataggtctggagcttacaccagaggaacctacatgaaccagtttccctaacccacctcgatctgctatttatttgttttcccccaagttgctgtcactagagactcaacgttcttttcctttgtcttgttgcttctttcaacatttactgttctttctcgaagctggaatttaaagccacttctttgagcactactcattccctgggtgtctcccatgtatgtgtgaaatatacatgttaataaacttctgtattttttttcttgtgttagtctgtcttttgttacaggggtctgtttcaactaaggacctatgagggttgaagaaaatatgttttttatcccctatgctaacaacactgcagcctttcctgagccttccaagcgagttcctgcctcaggacctttgcacattcttcccctacatcctcacagggtggcttccttctcagacccaagtcctgcctgcagcgctagcttctcacggaggcccttcctgtccatatcacaaaagcagtcctctcctcccatcaccctagccccttaccctgtttattccttcctagcactggtcagtaatcctcaatatttattagcttaccagtaatggctctataaatatacatttgtagtggcctgtgtcattcgctggggtatctcctgtgcctggatcaacataagaagtgcttgattaatacttttaattaacaaatgctcttgcctatcaaccttgcttttccagctcctttctattgcattggacaataaagcacaatgaatgtgccccgcccagggaggccaactgttatcagtgtacatgtcttcttgattggattatgagcttgacggggaccgagaaatgtctctgactctacttctgtgtcatcagtacagagtgtagtacctgatacatagtatgtgttcaaaaattttttttgttttgagacagggccttactctgtcacccgggctggagtgcagtggcatgaacatggctcactctaacctcgatctcctgggctcaagccatcctcccacctcagcctcccaagtagctgggactacaggcatgtgccaccatgcctggctaatttttaaattttttgtagagatgaggtcttgctacattgcctaggttggtcttgaactcatgagctcaagaaatccttctgcttcagcctcccaaagtatcggagccactgtgcccagctaaaatcttttgttgaatgaattaatttggggcatgactgagaatatataaaaggggaaaaatgactgtgaatgatcagcatatatttcagaaaatcctgcattaaagcacatgcattagtttcctcattaagacagcctccccataggccctcttaaggcataattctgacaagcttgattttatattttaatctatattttgtttcaataaagaagttgggcatgcaaagggaagcacctaaggggtgagagaatgcatgtccgctgaccactcttttgctcgctagacctgatgaatgagacttcacagtggggtgagaatttccatcagaggctatgtgggaacaagagtgactttactttaaatgctaatccaccatgtaacttctgactaaccccacgtccaggaatgcctccaagaagtcgagttgatgtattgctctttatgtagaaacatctattcactgtaagtttcctccaaaacaactcttgatgctgttgcagaaatcaaagactgtgatgcctgcagccacctacacattcctcccagagtgcatacactttttccccagatctaggccctgggactggggggttgccatacagagatctacctgtcttgtggcttcccaagaccatgcttcagtctgcaagttcccctaacaaatcaccctataccatcagactggacttgtctgcccctttctttggtttcttggcttcttctttgccatttggggattgctttgtgtacacagccatttcaagaaacaggctgccactgtcttagaaaaacaacccctggcacatccagtgtgatgccctctcagaaccagttttcttctggaaggctggtttgatttagccaagacactcatgtccccaaagcttcttgacagcagaagtgacctcctgcaagtgcccagagctgtagagctggaggggagctgccccaaacagccttctgctctccaagggcgattccatcagggttagtttccctaagacagaaggcagaaccacagcttagggaaattcttatcatagtcgccatttcttgagtgctttctatgagttggaactttattgtccacctttcagagatttgttttaaactcagaccctgcaaactgtgcatcatcttcatactatagatgggacctggcttaaggtcacacagctgttaagcagggtcccagctctccaaacccaagcctggaagagtacaaattctgcagcttctctacaagctatccatctgggaagcataaaagagagaaaatgccatttcatatttccattttcttcctgtccttgtatacttagagcataaaggatgctgtggtagacagaatataaccccaaaccctgtgcctgtgttgtctcgcatggcaaaaggggttttgcagatgtggttaagtcgaggatcttcagatagggagattatccttgattattctggtgccttgggcatggtgccttggccaggtcttggctggaagccaggagaaaggttggagtaccacctgcttccacctcttctgagctgtgagcatgaacacttgagtaccccactttttgactcacaacccacaaggtttgagaccaacttgccccaaatcacacattaagaaggaggtggagccagactggtctgagtcccaagcctatgcttcttccaaaacaccaggttagaacagcggttcatagccaggagtgattttgcccccagggaacatttggcaatgtctggagacatttttggctattacagctaaaggtaggtgcacctatcagctaatgtgcagaagccaagaatgctgctcaacatcagaccatgcgcgggagagcccccaacaacaaaatactttccagttccaaatgccagaagtgctgaagtcgagagaccctgtcatagatttttctctagtaagtcatgtaatggcatcattaaactatcacgtgctcatccttttggtgggtttgtgaacaaaacaaatttgtatgagaccatttatcatttctttctagaactctgaatttataatttatattgttacagagtacatttaaatctgccttaataaaggcaaggaggcaaagaaggaaattcaaactcactaagcaccttctgtgtaccaggcaccatacatatcgcttagcagtctttatatagttcttcttgcataatagctctcaaggtggaggcttagggaggctggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcaggaatctggccccggggcccatgatttgccattttggcaaacagagcatttcaaagcatatggctcccagacgcaaggatgtgatacagagaagtgaggcacagccgagcacttcacccaggacccctctgcctccaggtagtggtttcattcctcaagccattcaggagggcaaggagggacttgtggcatgggggaaagggccccagtccttgctttgatactgactgcaatatgcagggcccgttacttattccccagctttctcatctgtaaaatgggtgcactgatccaacagaatggatatgaacatggatgctaattactattgtattattattataccattattattattaatattattattattattattgaaagatctggctcagggcagctcccctctgttgagaacactctgggcacacctcctccaatatgttaatccacacaacagcccatgtgatcatttgaaatagaattgagatgaagtctgtcctctgatgcaaacccgccaagcgtttcccattgcatttgaaatccagctgctgaactgaccaagctctgtggccatggagtttgcttccttcctgctctcttagttttccttcactttgaccctgttgattccattccagtcacacgtgcctccttgttctttctacaactgcccagtattcacgctcatgtcagtgacaacccgagaactggggaaggaagatggggctgagacctgggatcccaggcaaaatggcacatccatggatacggggacgatgctgccattactcctcctaaggcaggagctgtgaggaaagcagtggcagccagcaccttggacgtactccccatccatgcgtgtgagctgcatctaactcgcttcatgtatgttgtctcctcacagcacctagcacccattttacatgtgggtaaactgatgcatgagggtgggaacaggccagcaccactctactggttgcatggagaattccaaccatggtgggtggactctgagctcacagtcctccccacttcatgttggctgtctgggaaaatcatcttttgttctttacacatccacttttggagcctagaatctcctgaatgctggtcacactgctcccaatatggggagacgaacagtagtccttcaagaactttttgtcagcgtgaatcttgcctttcctcagtttaacagaaaaacaatgggcagcgtgtgaatgcaatgggcacttttccatcctagcagtttatttttgacacctcacagaagtgaatcattgtcatgtaactacatctcatttgcaaaagtacaaattgaaacagagttaatgccaattccctcagcttccataagagcttggtaattaaagctgctaaagaagaaagaaagtagacgcagtgtttccttcaaggcctggttccgctccccaacccagcctgcactctctgcagccatgtgggtttctcatgtcagctgaggcggctggagtagaatgtctccctttctttctcaactaactcttgagtttcttgtgaaaggagataatgcaggtaaagtacttaattccatgcttggcccataataagtactcaataaatagtattggtgataatgatgataatgatgaagaagatgatgatgattattttgacattaggaatggaagagaaagcggagaagcagggaagatttctgtagagatagacgggcggctattgctaagccataagcccctttccctcgccccatcatggggagtacaggggagcctcactcaacccaagcctgggaagagggactcacactaccccctgagagctggggacaccgtggatggaggtctgactgcctgactgcctgggagagagatgggctaatgatcaactgcttaaaacgatgtaggggttgaaataatattcctgagatctaatggactgcccccctatgcaggggactaaacattaagcctctgcatgctgatcccattctgtgaactggtgggagtgaattcacacatgcaactcacatgcgtgccccccccacccgaggccctggaatgcactgcccagacacactcaattacaggcctctgagaacgtgccttgcacagtcacacctcggcaattctgcccatgctgacttctccaccaggcgtgtctttagcctctgtcagccttggagctgaaagatccccaagtggtggatttgcgcctgacccgggatagtcccatgccctcctctgttgtcctccaagccctctgctatgttcctgctggagaaagcggtctgttctggtgggcattagtcaagttccatctgtctcccttaccagagcgccactcatctctgatggggccatgcccagaggaggggctcaggagtgttctgacctcagagtcgcctggcagtgcagcctggtgccttcactagtccactgtggcagggcaggcagctgttcccataaactcccttgggcaggtggcccatcatgtaattagaagccaggtgacctgataataatcaactcctgcctggctggaaagcccttgactttaaagcatccagctaaccagggcttcttccccagaattgtttactaccctgaaggggaaatgctatccacccatttatttcaattgggtacctgcaccttcataaaatggcataaactaaacaagaaagtccctagagtcctctgcaccccagttgtcacctgttgaggagctcatatataggggatatgagaagtgaattgtctgtggagctgacagccagcttgaagctctccctctgtcaccccaggaacccccatacctgtgggattaactgagcgcttcataagcccagagcagaacttctcccctcagcaattttgtgacgaatgctgaagattttggaacataatgtttattttttttcaagtttgaacattgagataactaagtcagttcatgtttgcattacattttgagcagtggtgaggttcccagggggagaacagctctgtgtctgcaggaacaccccccaaaggcatgggttctgattccctctagggtcaaagttgctgacatataaaggggaatgttttccttcctccaagaggttattccctgctcagccaggctccctgatgtttttattttagtgtttatttaacccacaagtgaagacaatgaaaatggtcaactaaattctatgtattgacagagcctattggcaataatgatctcatttgactctcacactaatccgtaagacagagacagtataagtcgggatctggacttttccacagagaaaacggaggctgagaagtggatggaacgggggagtggtctccagcctcaggtctcagcatcaacctccgtctccacccagcttctagaatcaattctcacatgcaaacctggtcagtccatgcctcctgcttaaaacccaacagtagcttcccactggcttcagggcagttctacacattaaggccttctgtgttctaatttctgtctacctttgcactttcaccagctgctggttcccaattccaggcacagtgtcagtctcctgcctctggccctgggctcctgtgctcctccttcctcttacaatgccccctcctcacatttgcccagtgaactcctccctgctcaccttgctagaccacggccaaccatttcctgctctgggactcttatctgacacaccaggcagatgggatggcttggcaatatgtcaattattactcttatttgattttacgccaatctttctcccaagggtctggtggctgtcctctgctcatctctgtagcttagacctagcacagtgactggcagacagtaagtaggtgtccaatagactaggatctaacttgaatgaactgtttttggtagaggaggccaaagtgtttatcaaagcatatgagaaaacagatgcttatctctagtccagtgcagtgggctgagtggtggccccacaaatatacatccatgtcctcatcctggagtgtgcaaatattactcaaatggcaaacatatgattaggttaaggatgttgagaggaggacctgggtcctaaatgcaatcacacatgtccttgtaagagtgtggaagatggagttttgggatgcacacataggggaaggcctgtgaaggtggaggcagagactgtgtagtgatgtggccacaagccaaggagcactggcagctgccagaggccaggagaggcgtgtggaagggactcccctcagagcctctgcaggggcactgcatccctactgaagcctcgatctctgccttctggcctcagaactgtgggagaacacattgctgtcatttgtggaactttgtcacagcagccacaggaaatggatacagcccaacagaggactgtgttctcaccatctcagcagctgcaaggaataattaagtgacaaattcctcagctggattcccagggattgcccaagtgacagtgaagaggaagacagctgctgacagaaaccacgagaaagacctatgagcctgacaggtgtcactgatttcaaggactgcagagccagttttgaggttttctacatttctgttgaaaaccccagcatacgcaccaaaactttgaagggctcaaaatctttctcagagcagcatttgcttggactgcttctgaggggagaggttttctggagggttttggcaaaaaatcataaggaacactgccacgttttcgcattcaagtttcaggcgataagctcactaattaactctgccataggctgcgggaaagtgataagtactaaaaccgaacatgtgaaaatgcaagggagaacggctggaaaaaggagactttggagttgggcaggcatgcgttcaaatcctggctgggccacctaaactatgtgccatgagatgtggcccaagcagggctccctggagctgtggtgtcctcatggggagaggagggtctccttgcggagactttgtaaggattagggtgagtgtggccaagtatctagcgctgaccaagtgcttaacttaggaagatttttttggggggtgtgtggggtcttgctgtgtcaccccagttgcagtacattggtgtaatcttagctcattgcaaccttcaactcctggactcaagagatcttcctatcttggcctcccaaagcattaggattataagtgcaagccactgtgcctggcttggaagataatattattaattttaaaagttccctggtcttcttgaaaaagcagaaagtgcaccataaccttggcaggcagcttgcccactcaccattgtttggcattaagagtcagatggtggaaatcactcatttccaaagccctggtaccctgcatctacagctatgtagaggattaggaaatactttcctgccaacttagtggctatattcgttttctagggcttctgtcacaaatcaccacaaacatggggtcttaggagaacagaaatttattctgtcattgttctagaggcagaagtctaaaatcaaggtgttggcagagttggttctctctgcagactctgagggagaaaccatccacgcctctctcctggcttctggtgctgctggcaatccttggtgttcctttgattctagatgcatcgctcgctctaatctctgcctccaccttcatatgcccttctcttccctgtgtcctctccttgtcttatacggacaccagacattgaatttaggggccaccctaaatccaggatggcttcatcttgcgatccttaactgagtaatctgcaatgaccttatttctaaccaaggtcacattctgaggttctgagagaacaagaatctttgggggatactactcaacccattacagtagctaagagcacaaacactgccaacccactgacttcaggggcacctgccccataaaacctatgagttatgacctctcagaaactcagcccttcatgtgcaaagtgggaataagatggtctgtctcctgggctgccatgaggattgaatgaggtgaattgcacagccacaaggttggtagatctggccaccaattctggaggcttccatgctcaggaaagtggcttgggctgggatggctgctgaggaatcattcaggaaatatgtggaaatgctgtccctaggcctcctcagcagaacctggatgaggtccctcctcatccagggacccgggtgggggatgtttccccagggaagggggttctgaagtgcagccatgtagttagagagcccttaatctggttcatcccctcatttcactgatggtgaaactgaggccagagagggacagggacttgtccaacttactgtagattttgggaaagtcacagcaaaattccaagagcatcccagaccatctctcctgtgagttggggcagggtgcagtgggatgtggtacctctgtgtcctggccaggaatgagggctcagaaatgccatgaatgaaagtcacattgtcagctcaaggtcaattcatcaaaaagcaaagactggtaaatgcatttttgaataaaaatatgttaacaaaagaaacccagtctgtgaatgtgcaggaatccctctcactatctgaacctttgctatccagactcctgttttccaaacgcttgaatgaataaattcgataaatgtgttgctatatcgcttgctatccaaatcctatttcctgttgtatgcataaatttctggaataaaatggatttggaaagggaaagatatatatattctttttgtggataaaagtatattttatgccacttggctgaggcttctctctgtttactaacctccagctataacaacagggaactgaagcagaaggaacaacaacaaaaaaaacattctacagaattcactacgcagacatgatgaagaacttagaaactgatcaaagctgttagaaccattccattctatgcacaaaaatgtacattgttcataaatagttaaaagagataaggtaaatccagcaaattgtgtttctctatgatttgactttcagcaatgtgacctctcagtgcattgacttttgatgaattaactttcattaagttgctttgttttcttcacagctaacagctagaggggtggacccttggaaatgaccataatatgttgagactgctggaatggtcaaggtcttcaacattcccctatagcctttttgcaccatagcaatttgtgtccttattgaacattcctcagaatactccagtttgagtgtaccatatgttcccagtggggaccctgacccatgactgttattgaaggtaagatccctaagggcagagactctatgtgtgtgcacatgcatgtgagtgtgtgtgtttgtgtgtttgctcctccactgcatctccaggcctagaaggaggcccactttctagtaggctctcagtgattatttgtggaatgggggtaagtgaaggaaagcccataattctcatctcttgcctattctacagttactgcctccaggcaattgtagaatagccacagttctttgcagcccctccaatgggagggaaagtctttccccatcccttgaatctgggcgggctttgtgacttgctttggctgatagaatgcagcagaaatagtgtggagttccaagcccaggcctcaggcagttttgcacacttccccttcttttcttgcaactttgccaccatcatataaacaaacctggtctagtctgtgggacagtgatggacatgtggtcaagttacccttctcagtgccagaccaatgagtgaggctactttggactagctggtgcccagatgacctgccagctggatgtagataggaggaaatcatctagctgagatcaaagaagcctgggccagaagagcaaaactgccacactgactaactcttgcgagcaataataactggttgttgtttaatccatgaggcttggcggttatttgttacacagtcatagctaaccgatacaaattccttagtgatctttctgaattcactcttcccaagcctctcccatattccacattttacctctggtttattccctcctctgcagactttttaaacaccagtgtgataatgctatgtcccagctcaaaattctttggtggctgcccacttccacaaggacaaagtttaattatttcagcctgtgaggcccacgatgatctggccaccactttccctgcaccctgatgtcccctgaggcccttttactccagagcgtctctccagttttacatgtgtcctaggcttccattagcatcctctctgatgtctgtcctctactcagacattcctccttttccctttagctggctacctccaggtccacttctagctcaaatggcacttttgctattaaaaaaaaatgcccctttctcaaataaaatattttacaagttagtacattattgaataaacagaatgatcacaccctgtggccaggcccagccttgccaggggagttctccagatgccctctctgatggcagcagccctgcagatgcacatgtgtacccccacagctgtctgcttaccccacccgtgagccagtgtacacctaagctctgtgcccttcccacaaagtggagcaccatgccagttttggaaccgcgcagaggatgagaatcaggcctctgagagtgggctagaaaggaagctcagaggccatctggagaacggagtgcacatgtgtgtatgtgcatgtgtgtgaatcagtatatgtggatgttgtgtaatcccagctgtgtgcatgactgttttgcttgtgagttgatgtaggagatggtgcagtcctgttgtgtcagaacctggctgggagacctcacatccccacatcggcacccatgttctcacaggttagtgtctaaggtgggatgctgtgtctttagaaatggccataagttagtgtctgtctaatgtgggacgctgtgtctttagaaatggccataagttagtgtctgtctaatgtgggacgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttactctctgtctaagatgggatgctgtgtctttagaaatggccataggttagtgtctaagatgggatgctgtgtctttagaaatggccataggttagcatctgtctaagatgggatgctgtgtctttagaaatggccataggttactctctgtctaagatgggatgctgtgtctttagaaatggccataggttactctctgtctaagatgggatgctgtgtctttagaaatggccataggttactctctgtctaagatgggatgctgtgtctttagaaatggccataggttagcgtctgtctcagatgggatgctgtgtctttagaaatgtcttcttgtgcagtgcacaccctgagaacccatacttggtggctctgcttgctctgactcgatatttagaaatcagtctaagttgtacctcctctaggtaacctgacatccattcacccagacacacatctcctctgtgctcccttagtacctgggacctgcctttagcttagttgcctattgtagaccttaagaactctggctctggagtcaaactgataggaagtggaattgtggttcactgctgtgtaatccaggtaaagctcttaaccgctctgagtctcaacttcctctatccacctccccttttccccccagtgacaaagccaatgactacttcttcctcttctttacttggaaactgaactccaagctcctgattgggacatttcttattcctctttgtgctcccagggctgaaggactaattacaatgttattgacttaacctccattggcactgggcattgccctgtaaaaggacatcagagtgtggggtctgacatggggcaccaaacaaagccataggcaagagcacatcacattgttgaatttgcctgtttggttctcagaatctcaaaatagtttttgataaaagcggaaatgaatctctgccatgctttgtcgacaggggtgagaactggttcttgggaggtggcaagaagtcttaaatatcacaatggtttgcagagctgcaaaagcttagccctacctgatgaaatcttacttcttagtgtttatattcttctgttatggagaaatttaatgaaaattagtttacccctgaggtggttgaagcttcccactgttgttcgtcccaaggggcctccatctctctctggttccctatccctacccacagggctataaatagtccattcacagaactgcttttaaaatcctggcagtgcatgcttgtaatctcagcactttgggaggccaaggtgggaggataacttgagcccaggagttccagaccaggttgggaaacatagcaagactctatccccacaaaaaaatttaaaaagtagccaggtatggtggcatgcacttgtcccagctactcaggaggctgaggtgggaggatagcctgagtccaggaggtggaggctgcagtgagtcatgatcacaccactgcacttcagcctgggtgacagagcgagaccctatctctaaaacaaacaaacaaacaagcaaacaaacaaataaaaccctcttgactgtatctcctgattccctgattcctgctggacctggatgaaatttcacatttatataatagtttagagttcacagggtagttttagatagctcatcttttaagtcccttccctaaaagcctgtgtggtaatgggtgtggagtctgagtctttgtttctagacagggactagcaccaatgctggagttaattctcaccttctgtacgaattcattttagagacattgatgtgtcctgagcaatggctactatttagttttaagtctagatttgtgagacatttccatttaattttcattaaacagtttttcaaaaattatgactatatgccaagttggtgtcattatgtctcttaacttatagctatagttattttaatgtgcatatatttattccttctatgcaatactttctgcttggtccggaggattagaaagcaatttgtcattctgctttgcacacaattccctaacttttgaggggaaaggagacatctgattcgactccccctaaagtgctgggatacttaaggtaattggggtgaggccaaggccacggatagggttctttctttcatctattatttgttcattcacttgtttattcattcaacaagtaagaatgtgcccgtacctgcctaagcaccccatcccaggcagggagaccttgctgtctgctggctgagctccctcttggggcagtgcaggctggtgcacagagccctcccacccaacttggggtagtgcctgcccccctggcaggagattcagaggcagacatatctagggttgagtctggactccaccttgcctcttttgagatcatggattcaaccttgctggcatgagagaattgaaagggatcatgtatgaacaatgtttggacgaatcccaggcatttgacacacatgggttccttcttttttccctctcctgcctcctgtaaatccagtaagcaatacttattcattcccaggtctgtctcttctgtgggctcctccagcataggaggagttaaaggactgagccctttcacttgcagggcagggccaggatgtttcatggtttcttctttccagatgttgcaggtgcaggcctggcattgagataatgtcatacaagtgggtggctttgactctttatgttatctgatgctcctgccatcttcctgtcccaggctcttctgggtctgctggacacagcctttaccccttctggatctcaccaggctcctgttggggcacacctgctgtgtgcaatcctaagagcctggctgggattctcaacactgtttgcaggagggtttcctcctcggggtcagccggggccagcagccaatgcagttgagagtgccagcccccttcctcctatagaatgtctatagtggtcattctcaactgtgccctgtccctctcctcttcctctgtgggggtagagacactgtcttgctcatccttttatcttcaactcccagcccagggctggcactgtggcataacacacacacacatatatatatatataaaattgcaatatatatatatttgatttttgtccctagtttttggcccagatttcttaaaagccttgggatttctggagtaacaagagtggcttttgtcatttataatgaacccctaatgtggtgactcaggtgggtcattagatggtttcaaggcagcgctggccatgcttggagggttggaaccttcagctccatcttccagcctctaaggaagggagaggggctgcaggctgagttcagtcaccagtggccagtgatggaatcaatcatgcctatataatggagcctccatagaaacgtctaaatgatggggttgaggtgtttcccagttggtaaacgcactgaagtgctgggaggctggtgtatccacagagggcatgaaagctccatgccccgtgatgcacccccataccttctgtatgcctctcttccacttggctgtttctgagttgcagcctctataataaagctgtaattgtaagtagggcactttcctgagttctgggagtcatgctagcaaataattatcaaacctgagggtagccttgggaacccctgaatttgtagtcagcagagcagaagtgccggctccctgggactctgtttttggttggtgtctgaagtgagggcagtcttgtgggattgaaccctttaactctttctgacactctggggaggcagtgtcagaattgagctgaattgttggacacccagttgttggtggagacaaattgaagaggtggtgtggaaaacatgtgtttggtgtcaaaatacacacacacatttggtgtgagctgtggtggtagaaaacaccacacaccacacagtaggaacttaatgagtatgttttgaatgaattcatgaaaaatacaagcatttattgagtgctgacccactgtcaggctgtgtgtttggatacaggtgatagaaacaaggttcttgtctttgaagcagtccctgatgttaggaggactgaccaaccatggccattgtaatggggtgggggtggggatacactaggagttaatctagggggctgtgggagcccagaggggcgggctgtttctaagaaagtctcaagatgcagtatgagctgactttttgaagatgagaagccacacctcaaatggatgaataagggtggttgttgcaagaggggaaatagcacatgcaaaggctgagaccatgaagcgtgtgtgtgtgtgtgtatttatgtgtgtatgtgtgtgtgtgtgtgtgtttgtgcgtgtggggcagggggcagctgcctgtggctccagatggctgcagtgcagggagaatgcgggatagagagggagggcaggcagggcaggcagagacgaccacataggttctgtcaaatgctgatacgcccctgcagtctttccagaggggtcctttttccaagcaaggtatgtgctgaggcatcttccatcaggaccgctccatcttctggggtgctcagaccttaattcgcaccttgataatggcagtggccttaccgctccatcttgtttgcatctgtccactccatttaaacacaaactccccatagaggacttaacttggtgccaggcacagagtcagggcttcatgtgatttttaaaactggaattgacacattttggcaacgatcttctttttttaaaaggtgaagctcttttattttgcctcatttattagacttccctgccactgccttggggttatgcacacaaataaaatatgcagcaggaaactgcctctcttgttttctttctttgctttcacctaatttcaactccttgtcaagtcttcttacatcgacctgttcctcacagaagctgcctcaggcggcctcctggccctctcctgggagatccatccctcttctttaatcatggagagcaggcccatgagtctctctgccattcagctctgagcatcttcctgccacactttcccgggtggctcccctggggacttgctcttccctgtccacttaggaagatgcaagatggtctcatggtctaagtggcagcttttcttagacaggtaagttccctgaggctttaaactgtacactctcaatgtgagtttaaatgaagcttctaaaccctggtccatcttgtggctaaagtcattgctagccagcgaggcccaggtgctgggtcaacacagggggttgaagatggattgaggaagcggagggcaggggctgacaggtgatctgggattgggaggtgcaggtggccttccctccagggagtcccatagacactgatggggagcccagcatttaaagccctggaaatgcagcatgttctacagtcaaaagaaagccacagttgcaaacacttggaacagaatcaggatcattgcaaaaagtcttgggagggcttaggaaaaaaaaaacagagaaggctaagcttagtgatttttggttagcaaagaacttcaggcagatatgcagatgagtccaatctggcttgtttgtgtgcatgggtggggaagaaggtcaacttttcactcagatacaatgctgacatttaccgtttcttctgggaaaacagctgttatggaaaaagataactcgagaagcattaaatcacaccatgaaacatacagctttcttgccctcatgacctgcacttatcatagtggcaatgcccacacctttgcaggggtggcactgtcccagataactgccctgggctggctgctccaggcccctggctggtgtctctgcctccagtttcttctcactgcaggtctgccctgtgaaattcatgcacacagactccccaacagacctctagtgagttccataaaaccgcaaatccttagtgcaacagccaagacgctctgagatttgcttctagcttatctcctgactcctcctctgtgtctcaccctgcactccggggagtggttcctgacgagcacttagctgtcatcagatgaggcctgaatatcaatgtttgctttggttttctttctaagccaccaagtgatggtaatatattcagccagggtttaaaaactgctctagcccagtggttcttgaacttggctgcaccttggaatcatgcagtgttagaaaatgccaagcctgggccctagccctccaagattatgtcttggttggccttcagtgcagcctgagcaccagggctttaaaagcttcccaggtgactgagcaatgtttgagcaccactgctgtggctctgatggtttatttaaggttcgtttgacatgaacttcttcctatattctggcagtggctgctctcactgcctggaaattcctccttccctacctcaccagctagccctctcccaagttccaaatttcagagctgaggaactatagcaggggttgacacatgtttaaaataaaaagttagaaagaaaatatattaggcttttcaggccacatgtggtccctggcatgcattctttctttcccccttttaaaatgcaaaagccattctttgctggtgggtcacacaaactaggccagggaccaaatctgacctgtggacaattgaattgcctgttttgtgaggcagtgggttccctgtcaatagatgcaatcaagccatggctgaaggaattcctggcagggaaaccatgactaggacttaagcttctgataaatgactgaactagaacatctttacggtcttttccaaacttgggatgccttaattctaattcatctcagcccctggaaggtttcctcatctgccagatgacctccctccagcgctgaagtcattcccatgttgtgttccgcctcagttaattgtgaagatctgcatgtgtcagcacagacttcatttcaaaaccaagtgctatgatttaggtgtctttgaatttaagagacaaagaccaaagattgttcttgacctctgcattgagataatacctgaagcaggaatggctggaaccatgaaaatcaacatgcttttaattcatcctcagccaagctgatctgacaactagaaacaaaagacaaaagtatttctttccacatagacacaaacaggactgatttatgaggatcaagagtaaccccatcctgggaagataaaagcaggagccccctccccttatcctcaattctctgtgtaggccatttctccttggaatagtttttaaccttgcaagtaaatttcaaaatgggcataattccactcaatctttagcaaagagctgaggttctaggacaagatggtgaagatttaaatctagcatttgcctcttagctatgtgatttgggaaaaattactggatcattctgaatattggttttttcatctataagaggccgaggcaggcggatcacgaggtcaggtgatcgtgaccatcctggctaacacagtgaaaccccatctctactaaaaatacaaaaaaattagccaggcgtgatggtggacgcctgcagtcccagcttcttgggaggctgaggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatattcacaatgtttttagtgggctatacctggtctacttagatggtaaggtttagctatggggctagcttgctggaaaatgtcagtgttagctgaaaaattatctgaatataaaatgcagaaaatagcttctttcatggaagtgatgcatgtatgtcctttttagagccctcatatgttaaatctggacaactatgcatcctaatgtggcaaagaagaacagcaagctatctacacacacacacacacacacacacatacacagatttgaaaatctgactctattatcttatattcacctagtatttttgtgaaaattaaagcacttagaacagggcctggaatagagtaagtgatcaataaaagttattaccagagactggatttggggacagatgtgaatgtgctatggaaagtccagggtagtgtgtagaggtgaatttcttatgtttgtcgtggaacgaaaacagcatagatttttaacacttgggttcacatcctagctccaacactcactagctgtttcttatcaggggagcccctaacccctgtggacttcagtttcttcatttgtagatgagagtggtaatcctaatttgcaagcccatcttgcacagtaggggtgatgtatataaggcagctggtgcagtgtctaagttaaagttgatgctcaagaaaggctagtggctgaatgccattatgagtggaaactgagcaagtgcggcaaggactgggcaaagaacaggacagagcctgggaagccctaagccactgcttctgggtttaaccaatcactttaagggtgccctgtgggttcagcacctcccagtccacatcttacagcttagtgcctactcagccccttctatctgagttccctggtcatgattaaaccacctgcaaatacgtcctgacaaccttctagatgtcaggccaggactgggcactttaggagaggctgatgtaaaagtgccaactctgcatccagggctggccatgggacttgtcatcaccactggaatacgagtggagaagagggtgttaccccaggtcagggctcttaagaagctttctgcacagtctttctccttttcacctactggatgcagtagaccagagacactcggggttggcagagccacagcccaggaggaaactgggtgcatgtgctcatctacctgggacactagccatgggtggttctatgagtgagacatggatttctattgtgtgaagcttctgtcattcagagacatatttgttaggcagctagcgttacactgactgatacatgctgttagtgactcagaattcagactgcacatgtgaaacattcaaggtgcctgctcaggagcatgttacttttttaaacaatttttttagaaaagagatgggctttttttctctagcaccctggctagagtgcaatgctgccatcatagctcattgtaacctaaaaattctgagctcaagtgagccttctgcctcagtctcctaaatagctgagattacaggtacattccactactacacctggctagaaatgtttttttttttaattagtaaagttgggcttgaagatacaagaccattttttggagggttggcaattaagaagccattggccatctgtgcaacagtgtatttgttggatggaggaaagtgtgggagaatgtatgtgataatagacaaacccttcagttttgactttaaggtattaaaaacctggttctcagaaataccatttgacccagcaatcccattacttagtatatacccaaaggaatataaatcattctattataaagacacatgcatgcatatattcattgcagcactattcacaatagcaaagacatagaatcaacccaaatgctcatcaatgatagactggataaagaaaatgtggtacatatgtaccacggaatactacacagccatgagaaggaacaagatcatgtcctttgcagggacatggatggagctggaagccattatcctcagcaaactaacacaggaacagaaaaccaaacaccacatgttctcactcataagtgtgagctgaataatgagaacacatggacacaggaaggggaacaacacacactggggcctgtctggggtgggagtggagggagggaaagtatcaggaaaaatagctaatgcaggctgggcttaataccttaattgctgtcgataagtacagcaaaccaccatggcacacatttacctatgtaacaaacctgcgagtcctgcacatgtatcccggaacttaaaataaaaaagcaacatgtatcccatgaaaaaaaatatggttctattttatcttcctcctgcctacccctgctctcctctccctccagcttggcatacaacaggtgctcaataaaggcttgagaaattgataagaatggaattcaaccttatatttgttctttctctgaaaagaatcttggtattagcttgactaatccttttgctccatgcaattggctagtgccaccttcatatttttctgatatcattaagccccagctgcctcttccctggagctcagggatattgcaggaaaaggggtctgctctctccacttcttctctcctccaaggtttgttttgaaaaaccctgctgccagggcaggctcccgtgttacgctgctcacaaaagcacacatcttccctgccagcctttgctcagttattttattccctctctaacaagtacttgtggagccttactatgtcttcagcacagttctaggttatcaggataagattgtgaaccacacaccaggtcctttcatggagcttattttctagcctggaggagacacacattaaagacagactgcagcacacaggccgcatgcagcccactgcctgcttttgtaaataaagttttactgggacacaaccatgcagtccattcatttactcgttatctatggctgtgtccacactaccatggcagaggtgagtagttgtgatagagaatgcatggtctgtgaaataaaagtatttacacctggccctttgcaggaaaaatcttcccatgtctgcattaaacaaatgagtacgcaggaaaccaacatgcctgtgaacaatgctatgatgggtgatgagatagagggtaggtgtgcatgtgtgtgtgagtgtatatagtaaatgtgtgtgtgctggttttagaataagtggccaggagaggcctcactgagcagctgacatctcagaggggacttccacaccagaggcaagcccctctgggagcagagactgctcctgtctggtttgctcacgcatgtccccaggctagcatagggccgtaggctggacacctccagagcactgatgtgaagatgtggatgtgaggttgtgatgcagatgccctggaagactaaacacatttactcctcgcgtccactgtaaactacaacatgtgctgtgtgttcatcctctaattcgctgccctgcctgggaggtgcttgctttctttttcttgcagccgttctgaccaccctcatagcactgtgtgtgtgtgtgtgtgtgtgtgtgtgtgtgtgtgtgtgtgtgtgtgtgctgtgtgcatgtatgtgcacctgatgccctccccaaccattccatggcccaccttgccaccttgccatcttattataatatcccgatgtcctgaatggacactttccatccaccatgaatgcaatagaacctggaatgtaatggcttacgagaatcagcaacacaaagggagaaacagaagttcagttccctttgttctgatagaaacttactgtttgcatccaccaagaaacacaaccaaagaacagccatgaatatcatcccatgagagagcacatggctgtgtcagaccctgccctgagccccccttctcagtctgaccttggactctgctggaggtccctgctggacgtggacacagggccagggaatggtagggtcctcagttgcattgcatccttgtcgttgtacagatggggaaactgaggctaacaaagagaagaagtctctcctactgacccatggctaggaaacagcagggctagaagtgagtcccaggtaaactgaggctgggatactccagctgcacactcacacagctaccatgtaagctggtggttggggcctgggcctggcagtcaggccactccacctactcgctcatgcaagtcaccttccatctctgtcttctttggcactgtcctgagccttaaatgagctcacacaggtcaagttcttagccaagtataacacaaaatcaatgaacaatatgtcttagacatgattattgccacatctttcaccatagacggtaactgcttaggcacagactgtgacttggttgtctttgattcaacacaaaccagtgtcacctctggatcagagccctcccgcgtatgaactgctcttgctgtgtggtgggaaattatctcccactcatcttcaggtgagtccactttcaccttctgtgggatagactgcagacagtcggctacatttaaattgggccaaaagaaaggcagcagacacacatccccagtcaggctttgcttcttctgggctctgggttccccatctgtatgaggagagccccccagcttggtgatgccatgagtccctgggcggggcagtggggagggtggggtgccttacctggcccactgcagaaagaggcgatgatggccagaatgcccacgatactcaggtaggggacccagggggcgtggtcctgggagagaacagggagtggtcaggtgaggaggtgatggtgtgaccggaggacctgagttcccaccccagctcctcctccatccatctgtgtgaccttggacaggtcacttgatgtccccaagccccagcttcagcatctataacatgggaacaatgataacccttcggtcactccatctgcttattttatagccatgatgaaatcagatgaagcctgtgatgagtttgacatagtcctggcatacaggaagtggtaaataaatcaataactcacattgattgagggcttagttggcatcaggcaatatgagcaattttcacagctttatcacatttataaaagttcatcattctcagcaaactgacacaagaaccgaaaaccaaaccccacatgtctcactcataagtgggagttgaacaatgagaacacatggacacagggaggggaacatcacatgctggggcctgttttggggggtggggggctggaggagggatagcattaggagaaacacctaatgtagatgatgggttgatgggtgcagccaaccaccatggcacatgtatacctatgtaacaaacctgcacgttctgcacatgtatcccagaacttaaagtatatatatacatatatatatatatatgtatatatatgaatgtttcctcatatacattttaaaggcttctatattttgcttaaaagaagttatcttagttctgatattattacataaaggaccttatttgtacccctgccatcttgcaaggtgtgagatgcgttaattcatttcatggaatatgtctggagaagctgtcactcatccggggggtgggtggcttggtgctggttgggattgctcctgctctagcagactggacagctgagcattagaacacagtgtcaccagttctgaatctgtgggggtgccagggctgccccaggagaggccacctgacttgaagggaaggtaagagcctgcgttcatctctgtaggctgagccagagtcagcccagtgggaaaggaaaggaaagaggttccagtagggggttcagcatacacaagggcatagaatcctaagagggcaccatcggcgggggggtaagctgcaaacagtctggagtggagggcgaggggtacagagggcagacagaggaatggggaactccctccttccccttgttctatgtccaaatccattagctttaggggttgagaggagcttcatggactcttgtacactgtatggcttgcttctgtaccaagtcactcactcactcactaattcagctgattgatccgagctgcccctgggtgccaggcactgggatgggaggtggaaatgcagatatggttcatgccaggcccttgccctacacaactcactcactgtctatttggagagagacatgtgccaacagtgaaagtcaatggtatgtgataagtgatctcacagggttcccccttggggcttatgggaacacaggagagagcacctcacccagacttggaagcaaggggaggcttcctgcaggaagaggtgtccaggaatgtccaaggcctcctgagtccagagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggggtttgtgggcttcaggctttccttttaaacttcggacacaagtttcagaaagacaatggcctggaacatcgcctaactggcttcctgagaactttgaaggactgtaaagatgctggagcttgggacagcttgggcctggctgtcaggaaggaactgcatctgccagcacattgtccctgaaggcaatgcttccacctcctgccggtcagcgtgcttgccagccccacctcttcaaagggcacccatcagccaccaccatgctaacagtgccttcttctagaaacatttgggccactaagacatttgacaggtgatcaaaatgtgcacctatcaatttccagatgcatttttgaaaaatgcaaagattaatcaattgctgcaaccttgcttcacgcttcccatggcaccaagatgagttggaggtactgaggcagtgttcagttaatgcaagctgccctgagccatgcagggggcagaagcccaggatccggggatctaattgccaccttttggtggtgtaaccttgggaagcttatttatttatatttatccctcagtttccttatctccataaaacaaaaaaatactgatgttgtaaggatgaagtacatcgccacccctcctccttcatggacatccactgagtgcttgttccaagtgctttcagtgcattttctcatttcatcccacaacacccctggatgaagggacgactgtttcattttagagatgaggcccggagaggagctgacttgctaaagtttcattacaagtaaggaaaagccagggtccacacaggctgtctggctccagagccactgttcctaaaattgtgacaactagggaagtggctgatatgcagcacctggcactcatgctgggaggtgacagctggaaggagcaccttaaggttgtctagtgcaagctcttctattccatagatgggtgaactgaggctcagagatggaaagtgtcttgcccaagatcacacggctcatcagtgagagtgacaggaccagaagtcaggtctctcatctcccagtccaaggacccctcaccaaaccctcttcactgagaccctcagcagctccagagatgagatgtccccggggagagctttatcacaagtgttttctgtagaagtatgaacccacaaatcaaaggccccaaaacgatgaagccagaagtcagctccatgcttatctccctcaaatgtgacaagaacatcgtctcacctgcagggtcagcgtgatggtgagggtcccaaagaagaggcccatgagcccaaagccaccaatgaggaggggtctccgtcccaggtgctcaatgaccaaaccctagtccagggtaaaagagagagagagagctattattccatttctaaccacaacaggggaatgtggcactgggaaccggcaatggcatcatgattaaaaaccggctttgaccctgagacagttgggccaccttctttatggccacagccctgaagcaatgctctttatgagaaaggaaaaagcgagggagagaaagtcacaattcttgagcacctacagcattaataacgagcactctcctccgaatcttccttgctatggtggactcctccaacagggagtctgggagaaggaactggatggatatggtcaccacagcccttctcctccttcagaggcaacctgcatggaaggtgactcctctgtgtctccatgttgtgggtttcataggggtaggcatccacagcggggcacaggggtgggagtaggcagagaagcccatgtcgttttccagtctgcctgtgtctggggaagtcaatttcattgtgggatgtgatgtggggagtccctggggaagtccctaaagctgtgtcctcgaagccagcttccctcggcctaggactgtcactgacctccatctggctggcccctgtgccccttgtccacttggtcaggaaacagctcctcaactgccaatgactgaaagagtaattgtagccgaatgtcagagacaggaaaacctgggtttatattccggctttactattttccagatgcacgaactttggcatgtcacttcacttcccaaagccccagggcctttatctgtgacaagagaatcaaaatatccttccacaagagtgtctggagtggaagggtgtgttaaataagagactgcactcaacacacaggttaggtactcggattatgtgaggtatcctcctctcatgctccatatcacaaaaagagaacacggagggtcagagaggtgagataacagcagacatcacagagcaagtaggtgagagagggccagaaattgagcccagaatgaatcagaatccatggcttttctcaatgaggcaatcaggcgaggcttcctggaggaggcaggagcagacagagatgtggagagcttgtcaggcagagggattagtgggggaaaaggttttggggctggatggtccccatcacgacagtcatttggcttggacaaggggaagcagtgacgctgctgagggccatgaagccagagcacacatggctcctgcctgccagcttcaggtgacagtgcgaaggtcacagcactgagacgaacagttgcaatccttccccaaagcctcagggtttctccacaatggaacccagctgcagggaccccagtgccctctacctgttcctctttcctcataccctgctccttagagggaggcaggtgagaagccgtctaggcaatgggcgttctcccccaagcttagcatgggctgttgttctgctgggcagagccggcactgaggggtgagtgacagctgcctgtccgaagggcatagccctgtgggtcagctgagcaccccggccatgtagtgctgcctggggccatggacctctcagtcacctgggcatgaatgttgaggggaacggagggtgctggccccgaaagtcagaggcctgggaggaaaatgtgcctggctgatgaccacatgtctctaaaagcatccaagacttctggtcagaaatgcctttctcctgggtgcttagggaagaagggcagactcaagcctttaaacttggcctcctagaaacctggcccagtggaacagagcacaggtgacatccaggggcacaaaagcctgaagatgggccatctgagctgaattcctggctttgccacttagccttctttgcacccaggacaggttattcagcttttccaagtctcagtttccccacctggaaaatgagaatgataataccatttttgcagggtagctgtgagataaagcgaaagaactcacaatgcctgaaatagactcatgaacaaaagaggttgccaataaatggcaggaaatatattattcattttaactaaggagtgccctggggatctggtcccaactcttacccgtagctggctgtgtggccttgaacaagttaattaacccttccatgtcttaatttctcatcttttctgatgataatggagttagtctagataccaatagctaatgatcatttactgagcacctactatgtgccaagcactgtattaagcacttttcatgcagcaactcatttaatcctgacaataattttgagtaggttctattatttgctccattttacaggtaaaagaacagaggcacagagtctttggaaacttgtccagggtcacatggctggtaagtggcaaagctgggatcacctacaaaatcttttctgttgttgtgacattacattttcttgacattaaactagaaacagtcaatgccaccacttggtaacagcccagtgtctcacctggtccagctcccggacccgaacaagggcactgatcacttttctgcccccccaccccctcccccctccgcattcctggctctctgattctctttcttcacttgaaggctaggagccttcatctttgctttcccagagcctggaagaatacctgacaggtgtggcgtaagtgtttgctgagggagggaaggtctgtctttataacgcaggcagaatgattctcatttgcagggggagggcggggagggcagtgaggttcaagaatactgagggacagtaacttcacttggtgggaagtggggagggaagtcaggcccagtgagagtcaggagggaagcaatgaccaacagcttctgagaaagagagatagggggaggcagagagggacggagggagagaatgagggagggagggagggagtgagggagggagggagacacagagaaacctgcatttaaagcatcccttcctcttaggccctcatgagctgggtttcatcaaagaggagacactgatggggctgctgtgccaggtccagtgcaacatgggcaagggagctgggtcctagtgccaggagggacccccgcaaaggtaataggagaaaaggcccagagatatcaggggcttagagagattatgaaattatgggcccagagagattatgcttatctctgtgtaactcatactaatttcagtgtaacaatgcaacacatgttaatctcagcgcaacacatgttaatcttggcgtagcactctcagtgatctgggcccaggatcagaggccaagagtgattatgggatttaccaaaagtcacccagggctaactattcagagagaaggaagtgggatagatgctgttttacaccaaggggcagttgcaaacgtccacacccttggactcagtcactcaccttctgggcattgatcctaaggaaatagatgtttggtcaaagatgcatggacaacgatctttgttggtgtgttatttatactactggggaaatagaaataatctagaaatccaccaacaattagttaaataaatgctggaatatctagatggtaaatatgtagaaattaacatagtttaaagaattgtaaaatggtacagaaaaattctcagggtacaatcttaggcgaaaagagtaggacataaatctgtatatactaaaacatgtagttatataatatcaattacaattatgttaagctaatacaccctggaaaaatatatgcagaaatagtttataatggctaactctggttgggggaatatgtgattattattttatttgtctgtcagttttcctgattttctccggagagttttgacttaaaaacaccaaaaagtagatttagttgaagtgttggatgcaaatctctgtcccctgtattatgtctttattctttccaaatcaccaaatatttccaatacccatactggcaatttttcataactgtgtaaaatatggttttggtacaatctaaagatgtcacagcttttcttgtggctaacaggacagagccaaaagttaagctgttgctgaaaatgaaggttgttcataactggaatatgcaggaactctgtctcctaagcttcttaggggagttggattagagtatccagtgacctggtgctgaaatgacaacagaatgtgccatggaagagcatcacagttgctgggagatattattacactgcaatcagcatgtgttacattgtcatagggagatcagcacatgttacattgttataatgagattaatatgtgttatattgttacactaagcttatcatgtgttacattgttttacggaaattaacatatatgtttactgatttcagtattttgaagtttttaaaaaagagtttcaagtgcaccacccacaatttcagagtcagaaagtgtgcttacaaaagtcagttgagaaccattatcttacaccatgatgctgacgttcaaatactttggaaagggtggggtgagggacatgtggctttttgtttcgtttccctaaagtctcttgatgaaccagtaacttgagccaatgaaaggctgaacacattctccctgattcagaaatgatctttaaagatggtctaggaagacaccagggaaacagctttgaaagagaaagaagggataaaaacaaccctcccatctgacaatcagtctcccggctctgttcttcttccctccctcctttaagtccagttaaagtgcagcctgttggaagggattagagcgaacgtggtatttccacttgacattaaaatcatgagtgaagacattaactcagacgaacagcagactgaaggctactgatgtcagctagggatgactgtcaaaatcctaatgctcccaggaaacccctctggggactctggagccatggggtcacccatccactcagcagccattcacccagcacccagtgcccttccccacagggctgggacctctggtgaaataataatgggaaccttttgttctggttaggattttaagaagcagctttataaaggtgtagttttcattcagtctaatgtacccatttgaattgcacagtcttgtatgttttgacaaatgtatataccttataaccacaactacaattaggatattgaacatttccatcacttcccagaattatcttgtgtctcttcccccaactccaggcaacctccgatctgctttccagcacaaggattcgatttatcatttcatattgcttattgcagtgtttttgagattcatccttcttgtagtacatatcaacagttcttttgtattgctgatcagtattccattgcatggatataccaaaatttgtttctccattcacctgttgacccaatagctgtttccaattttcagctctgagaaataaaaccattatgattattgagtcttcatgtagacttgtgcattgatttctcttgggtaaatatgtataagtggaatgactgagttggatgggtaaaacctttataagaaactgctaaaatgttatctgaaggggttgtgccattttatgttcccaccagcagtggatgagccttcctgttactccacatccttggcaacacgtggtattatatcaaccatttaaatttttgtcaccattttggtgaacaatggtatctcactgttggttttagttttaatttccctggtgacagtaacaatgttgaagatcttttcatgtgatttttgatgttttggaactcttctttggtaaagcatgtgttcatatattttgctcattttcaagtgggcagttggtcttatttttgagttttaagagttctttatgtattctgaattcacgtcccctctcaaatgtgttttataggtatgttctccatgtctgtgacttacctttttatctccttaacaataccttttaaatagtcacagtttttaattttgatgaaatccaatgtatcatttgaaaaatggtttgtgattctgtatctttcctatcctaatgttgcaaaactttctcctttgcttctagaagttttagagtttagcttttatgtctagatacgtggtccattttgagttaattttttgtatggtataataagggttgccattcacatttttccatgtggatatctactttttatgacactacttgttgaaaagactatcctttcctcattgaattacttcagcaactttttgttttctggattccattctgttccattgatctgtggggctgcccttatgccaatctcatgctgtctttattcccatgtttgaacattgttacaatccttgctatgtaccaggaatggttccggctgctttatatatattaataacttaactctgattacattttcttggggtaggtgctgttatcatccactattatatccagaacttgaggctcagagaggtttagcaacctggctaaggttgcacagtgagtcagaattcaagtctaggcactccggctccagagtcttgctcttaacctttgtgttctacttcctctccccagtgtttctgaggcaaatacacattcacatttatcaaaagaatatgcacatgctcccaaagtttttctcccttcatttgtgtgagctgcctgaggtcactgagagcctccaacagcactggcactggggcacagagaagacagagccaggagtctctgcccttggggagctttatgggctgaattgcattctctcaaaaaaggaaatattggaatcctaatctcctattccctagaatgtgaccttgtttgggaatggggtctttatttttaggtgattcagttaaaaaaatgtgaccttgtttgggaatagggtctttatttttaggtgattcagttaaaatgacatcatttggatgggcctcaatccatgatgactggtgtccttgagccaatggaaaagggaaagtgtggacacggagacagacacgcacacaggcctgtaatcccagcactttgggaggccaaaatgggtggattacttgaggtcaggagttcgagaccagcctggccaacatgatgaaaccctgtctctactaaaaaaaatacaaaaagtagccaggtgtggtggtgcatgcctgtaatcgcagctacacgggaggctgaggcaggagggaggttgaatcgctggaactgggatgcaaaggttgcagtgagctgagattgtgctactgcattccagcctgggtgacagagtgagacattccacctcagaaaaaccaaaaacaaaaaaagacatacacagacagaatgtcatctgaagatgaggcaggggttgggatgatgcttctgccaactaagaaacacccaagatcacctgtaagttcctggaagctgggagagaggcacgggacattctccctcacagccctcaggagaagtgagcactgctgatgctttgctctcaggcttctggccttgagaactgtgatacaataaattcctgttgtttaagccacgtagtttgtggcacattgttttggcagcctgggcaaaccaacacaaggagctaacacctgatggagggcagggcttgtaatgttgcctgctaaatgattgaatgtatgtaaaaaaaagaaggaaggtagtctccaaatatgtacaactattatatgacaataaacaacattttaaaaaggaagagctggagggcaagaaaatatcgcctaaaatttaatttatttcaaatttatctcaattaaagcgtccaaatttgatgtaatgtgctttcatattatttcacatacattactttatatacactttatttattgctcattgtctatattgtattcaatgtgtatatctctctatataaactgcatgcggtactccgtgcatggcaggagttcctgactttctcagggactacagcgtcctacatgagttcttccctgtgccagggtgagccttttggtcgtagaagatgccccattctctgtgtccaactccaggccggggcctttttaaattcttctgatttacataatccccatccttgcctggcttgatgcttctgggtctgtgggccgtgtggactgattgtgcgcaggggccctagaagcctaccaggaggaagccctgttggttgggctctgcctccctcaggacgtcctgtctgactgctccctgcagggatcccagccaaaggcaagagctccctctttagtcagctggtgtgatttcctcaacaggctttactagagccgtactccgttgagcaaccattaatggtattgaatgcatgacaactactatggccatttctttaaacatgatgcatgacacacactctctctctccctccctccccctctctctctctctttctctctttcaaatttacattttaaagcaactctatgaggtttcccctaataactcagccaaagcggtgcagacaactgagactctttcagagagaaatgtaaatgctggggcaagatgtggcccagatgagggccaccccgcaggcatcccaaacagctgtttcctaatcctgacatgttggaatggaggagtacctgaggaacccttggcacatgagcaattggtgactttctagtcagaagttggattattgtcaaagttttagctgcaaaaggatgggagaaaggagcagagaatggtgtgattatcactgacgcagctccctctgcagagaacagaaggccaaggtacattacatgaaaagcaatttcacattccagtattacttttagctgctggtaatcctgttttaaacatgcaaaggctaatctttactttcacagatctctctaaaaagaagccaagaccttggaaagctgtggttattgcaagttagtgaaattttaaaatttatgttcagaggacagagtgccagaaacaattttctgcttgggacaggctctctctaagttaaaaacggaatataattcaatgaaacaaacttttttgggaatttctgcttaaaagatgaatgtgcataaaaggtatcggtgtatctgtttgggccaaaggtgtgagaaatgagagttgtgttttaaataatgatcatcccagggtggcccatgatctctaagtataacaaattaaaatgtcttgagatatttcagccaaagtgcaaaacagacatgggttttccttccatcccatgccaactgggatggaaggaaaggctggcagcagacaggcttttccaagttctccagtcctgtggacgtctcctccacttgggtcactttacaagcttggcttgaggccgtagcttctgcagtttctaagtgaagcactccccctcatgctcttactcttctcaaaaaaggcaaaatgtggttctcaacaggtttgtgaggatacattcatattgttcttggaaatttgggcaagtagaaaaaaaaatagctcttcaaggagcagagaaagagacactggatgtccagatgacttaggagtcagggcttccatagcaggagcatcgagttggcagagggcagtgggcagtgggaacagccgccacttagaactgacacaaggggatggtaaatgctgtctccaccctgcatcccatgagccacatccgcactttcctttggtgagtgaagctggtggggccggacacaggggagccaaaggatgttatcagagggatggggagtaaatcaggaaaatttggtgggaagtaaagactcaggagcacatcccaagagtcagagggtgagctgcaggaacggacttgtgggtatgtccttggccaaactcaaaaatagagctacttacttaaaagatattattcagagcttggggtgggtgggagtggaaactgcaggggaatgtgcttccagggcaaaaccccaccttttctgcttggggatgctggggcactgactctgtttcttcccttcctcatccccacccagtcctcaccccatgaggataacctgtcataaccagaagtattagttcattctcatgctgctataaagaactgccgaagactgggtagtttacaaaggaaagaggtttaattgacaaagttccacagggcgggggaggcctcaggaaacttacaatcatggtggaaggggaagcaaactcatccttcttcatgtggtggcaggaaggagaatgagtgtccagtgaagggggaagtcccttataaaaccatcagctctcatgagaactcactcactatcatgagaacagcatgagggtaactgctcctatgattcaattacctcccaccggtccctcccatgacacatggggattgtgggaactataattcaaggtgagatttgggtggggacacagagccaaaccatatcaacgagagtccacatttctctgcctgcttcctgctcaggcaatggtaacactaatgcttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgttaaataaactggggacttgatctagtattttagtggaggaagggtgtagtttcttctagtctgtgacctatagaaatgccatagaatcattatttatcaatgaaaaaggaatgtctgtcaagggaaattaattgaactcagtcctttcgaggccagttctagagcacatgtcagtgtgatgattcacagggaaaaccggcctctctccaagccttgtgacaacgctgtttctacccttgtcaccctctgccattatctattttgtctacagcagtcagagggatttaaagcatgacctggcactctccttttaacacccctgtccactaaaagccttatagacagcaaagaaaacaatcaacagagtgaagagaaaacctacaaaatgggagaaaagatttgcaaaccatatttgaatcccctcaagccccatgcccccccaccagccccttggcccctcaagcggcagccacatccttgcccctgccttgggctgctgcagacatccctgtcacctctcagattcttgctgtctgtcctagagggagacccattggctcaaatcaacaagctccctgccctctgacctctaggcggcttcagcagaaatcagaaatcagaggtcagaaatcagaaggcaaaagaaagagaatgaggccaggggttggtttcttggttcactttctacagagacattttgcctggctttgtccctctatcaaaggttgcagctcctgataggtggcgtacccaccctacatgccctcggctgccctgaattaatctgccttcgagctgctcaggttcactgtgtccctctttcccaaaggtttttctttcagcagcttcttttgcctgacatgctcttcccagacagctgggctcacctggagcctgaccacaatatttaaaatggcaactgcccccgtctctccattcccctttctctgctctactgttttctcataacatccttcaccttctaaaacactgtgtggggtactcccttgttacactgtctgtgaccccatgaggagctctccttctccacagcagagacctttgtctgttttgtccactggcacagagcaggggcccaagtgagcacttgctgagtgctggaggaagaagcatcctggccttgggctcgtcttctagtctttgagaggtagcagggcagcttcggcattttccatgtctgcttctcttcaggaatattaataacaagagtaactgcgtgagtttcccagggctgccgtgataaggtcccacagacagagcggcttcagcaatagaaacgtgttgtctcacagttctggaggctggaagtccaagatcaaagtgtctgcagggccctgcctctggaggcgccagggaagggtctgttgcagggccctctcctggcttctagtgtgttttggctttcagcagcacaattctaatttttagagggcgttctgcctgtgtgtatgcctgcatctaaattttcccttttcataaggacagtcgtattggattaggggcccaccctattccagtataaccgtatcttaccttaactaattacaactgcaatgatcctatttccaattcaagtcacattccgaggtactagggacttcaacacatgcattttgaggaggtgcaattcaacccataacaatagtgaacatttattgagtatgttctctatgccaagcactgtgaattacagtatgattcccatgacaatacctgctgaggcttagatctgttattattgccactttcactaagagaaaaatgggtatcagagaggttaagtgactagctcaaggtcacccagctagcagctgcggggccagtatgaaacagagcccagatgatctatcaccctgctttctcccttttaccacgttctgctctcacacgggctggatccagtgtcctgagttccagcagtaaactctgaggcctttgattctgaaattgtcgaatttattgggaagcaatggagactacaggcaacagaaaccataaggattttttttttttttactacaagtcaagagcatattccattcttgctaattatgaaaatgtactgcagtgaatcagaatgacttcctgtgaattctgacccctgatttgtaaaagcacagagtctgtgcttctcaagagtgagccctcaccccacaaagctcctgccccacatggcctgaatgacgctcactggaagttcactcatcagagagttaacactgtgccaggcaaatcaatttggaaaaccagctgtttctgaaagatggcgattatttacagttccccaagctgatgactgacgccctgagccaaaattaattgcagatcaaatgagcaaagatgtctttcccctctcaactttattagcctcctgagccattttaatagactgtcaaaatctcataagaggaatgaaaaaaattggaaagtctttttggataagcaatcacttcaaagggctggatgaaatatatagacatatatttgtgtgtttattacatatgtaactgtatatatataaatatatttattgccttcttttcaaatatatttcaagatatataatatattttgtatattatataaatatataaaatatattttatatattataaattttatatatttatatattttatatcaataaatatataaaatatatctacatattttatttccttgttttcaaatacataatatataaacattataatatattatgcatattatatatataacctatataaatatgatatttttatatatacataactttggaaagtgcaaggaacttaccttatattgatgctctgtgaggaacaggggagtggctttcacacactttggattttgtttccataattctgtcagatgctgtattagtttcctattgctgctgtagcgagttaccacagactcagtggcttaaaacaacccaggtggattatcttatagttttggaaatcagaagtctagaatagatcttgcagtgcaaacacgatggtgtctgcagggctggttccttctggaggctccagggcagaatcttgcctgctgcagcttctagagaacatctgcattcctgggcgtgtgaccccttcctcaccttcaaagctggcaatggcgtcactcctgcctctgcttccaccatcacatctccttctctgactctgaccctcctgcctccccctttcacttacaaggaccctgtgataatattgggctcacctgggtaatccagggttagctccctatctcaagattagtcccacctgcaacattcctttgtgccatgtaaggtaatatattcccagcttctgggaatcatggtgtggacatcttggggagccattgttttgcctaccacaggtgggaatggttatgtccattttacagatgagcaaataaattcagatgtgttgggcaatgttcccaagaccacttagctggtaaatgggtgatcaggatttgaattcagagtagcctcatcctaaagccaaagctgtttctccccagaacatttttctattccacactctcaacctcatgctgaatttagtttcatgcctttccaggaattggggtcaatgctaccattttaaggactgtttccaatggactattctgcatccatccttgcatctccagctctttgagaagatgaaagggggacagactacccaatgcacttcacttcacctaacttctgctggcccttcagctctcaggttcctggtccctgtctccaggaatccctcccagaaccccttatttgagagggaagctcgtctcagtgttgcatgtggtaattgtttccaggtttgcttttctctctagatcacggcaacgtcacctgtgacagctggcacagtatgagtgcaccttaggtgtctgtggaatggatgaatgcatgcctgcatgaaagaatccaccacccaagctctgaatcatcacttcctgctcagaggaacctcccacacagagattcctgcacctctagaacagcaaaacatcatttatccttgggtcatagtcaacctcctccattggactgtgagctcctacaggcaggcaccatggcaaaggccctctgtaagcccagcacagggccaacagcctgaccatgggaggagctggcaagagcttgctaaatggcggggtaccaactggccatggtccagatgactgagatccactgggtccaaacttaaaggcagtggcaggagtgctctccagaggctgagactctgagttctgattttagaaaggactcttccttcccttccaggactgtgaagtcatttaccctcctttctggggtttccaaggaatactttgcccaaaattgtcagcttttaaggaagatgatctgcctgccagagcatcgggatgagaaggagtggcttctggagtctggaatgaataagaatggcttcccgtgaagtcttcttgcaccaagggaagaagtgtagccacttcctcagtgtgcccctctttcaaacaatggcagtcattggactttcaggcatgatgtgagcattcatgaggtcccatgtagaacactttggggtgtcggtggcagggacagtaggggccccatgatgttctctttccccactctcttgggttctgagccagctgactgtgtgacccagagtaagtcactccttttggtcttagtttcctcaactgtcaaaagatagcaagaccccctgtaaaatcctgctctccacaaggatgtccatcgtagccttatgtaaaatcacacattatggaaatctacctaaataggacaagaatagttaccacttactgggtgtataccatttgccagccactgctggaatcacttaatgtatattcattggtacaatcctcagcccatccctatgaagcagggatgatggcttttagaagtggggaaactgagtcacagagatgctgaataacttacttgggggtcacgcggctaataaaaagacacagagctgggactggaacccagaaagcatggcactgccatcaggttccgagcagagacattcaacaacctcacccgcagacaatggttaaggaaattatcatacagaaaattactggagaaggataaatcgttcagcactagtgttaattcagggaaggtgatgatctacatgattttctgcatatatgatacacttcaacaaaaaaataataaataagaaaatggagagtcattctgacataagattatgtgaacaaaagcagatcagagctcgtatttagaataggattactgtgctactatgtaagaaatatacatctatgcatagaaagacaagggaagaatttgccaaacttccttgggtagtatgattgtaggtaatttcttctttgttcctctctatttttccgaattttacaaatttgccctaatgagctggtattgatttcttcacaacaccaataaaatactttacaaaaaacaaaaaacatctcccgtacttcccccataagtttcatctcagactgtgtttttccattgctcaaagtaaaaataaataaacaaaactgggtgcagtctataacttgagaataacaagaatgaatcttgtgaaacttccagaatgtgaaacgttgaaatgttttcttctaataaaaagaccacaaagtggaaagggaaagagacaaaacatcattcctctacattttttatggtatctattttttaaaagcatcttgttagaatgacccattaagtgcaaggtacaaaatgaaatgttctgtcaacaagaagtcagaaagacaattgcaagcctctgcctgtttgcatgggcatcaatcttgtcagtgcaaatcagtgagcaagagtgaaaataaatgaactactccatcaaggtcagagaatataactctctaattttagccctctctttccatttggaagggagcctaactgtgtgctgtgtgcccaaaatgtgaggcacagacatagctacaaaaaagaagagacacaagcatttcataaagaggacaactgaagctcagagatgttgagtgcactgctcagtgctacacagccaagaagtgccggagccaggattcaaatccagtttgatctgattccaagatctggaaatttctactaggttctgaagccacccaactttcccctccaccagatgtttgttttgcatattggaggttgagaaacagtgaggagctctatgccttcttttgaacatattggcttattattaaggtcttcctctctattatactggtcaactgaatgtcctttctcctttgccttgcaaactcccacatgtctggggtaatgagatgactgctaatggttttgaaacattttaaatgtcatggtaagagattggagattcaagccaattctctgatccgaactcctggggacaatatggccctgtttcacagggcattcatatttcatcatttgtgactaggtgagaattcaaaggatggagttatttattaaaaggaagatgacagggaagcaaaatctaggaaggaaatattctctagatgggtaaaatgtcagtgaagaatattctctagatgggtaaaatgtcagtgaagagctgcatgatgacctcctaaaatccagccccctttggcatgataaaggacatgctcctctaaagagatgcctgtttgttgccttaggttcccacattgcagtgttgcctgccccggaggtgtcaggaactgggtgagaattgtcgctcttcagtacccactttgaggttttgggtcaatagcccagacacaaatgatgtctgggttctccccatcccagctatttctttaaaaccaagagtttgctgaatgataggaaaccacattgtcctaattgatgaattctgatggggaaagcctgtgccttaaaggaccttatgaacattcccactgtgctgtgtaaccccctgtggcattctcaggagtaaccctcagttgacttacagagaagacggcagccaaagtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagatagaaacagtaatgttggtggggcttccaggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccatcgtaactttatgagaaccagaaaaggtccccactacacaaaacgctttactgtcatccactgaaaaattgccatagtaaatccacaatgcatacaaggtgaaagatgttccccagagttgggtaatgcacaacctgtttaactatacatagagcccctgccttgggataaaagccacttgtttagatgctggaccaggaagttagaaagagttagcctgtgcccttactgactacactggttctgtaatttattatccaaacatgaggacttttgagagtgttgataattatgctaggatgacacacttacattgagtgtgtcctgggaaaaccaggatgtgtggtcttggagttgctataccagccctcgcaacttatttcatgtgagactgaaaaccttccatcttgttgaggtctctgttggggtacctgccacatgaggttagacctaaatcctaattgatgcccatggcatcagacaagaactgattaggagtttggagacctggctccatcttgaactagctgtgtgacctcaggcaattcaccctgccatgaggagattcctactcctccccagtcaaatgaacatgaccatgcttattttgcctgtcccatgaggtgtcaggaactgggtgagaattgtcactcttcagtattcactttgaggattttagcctggacacaaatgatgtctgggttctccccatcccagccatttctttaaaaccaagagtttgctgaatgatagaaaaccacattgtcctaactgatgaattctgatggggacaccccctgcattaaaggaccttatgaacatttatgaacagtttgatacttattcagcagaagtgttagagcacattgctcataacctgtcaggtccaacgttagctggccacactctcgcattttgctctttgtttctggatgaagctcttgtttctatagatctgttttattgccagatgtttttagcaaaaattattcatgcattggggggaagatataggacctacttatatctacagatggttaaattttgtgaagaaagtaaacctccataaagttatgggcataccaagagatgccagtgaaaactacgacacccatttcttcgagcttgcaggcatggatacatccatctattggcaaaaacaggttttaatattcgtgtaaaacaagaaccttcatgttctgcacctgtttctcacttgagtgaacgttagactccatcgttagcctgaacctttgctgtcacatccatggtgtacagaggtagtgcctaataaatccactaattcctattgttctcagggctgtgacagaagctgacattataacattatcctgaaaactctatgtccattgaatatgtttatacaattgcttcccctttagaaggtaactatgatccccagtgcaccgtcagggttggattccagaagtgtaacagcctttcttaatcatcagccaaattcactgattttcaatggccaacgttctctagggaccctcttaatgccctcaggctgccaggctgtcacccatgtgaaggtgtctgacatttgtgttattcacagccgtggttctgatccccatggcctgaccagctcatggtcctgaggctcccagccctaggtcccacttaatgtgaatcctcttatgatgtggccagcacctccttctggctcctctcacccctcacaaccccgtcttccctggtttcaattctccccatagagacactgctatagatgtcccttagtaggttagtgaagagagtcattgtacataaaattctaagttcagtgagggacagttataacttttgcagggaaattgatgaagctggaaaccatcattctcagcaaactaacataagaacagaaaaccaaacaccacatgttctcactcataagtggaagttgaacaatgagaatacatggaaacagagaggggaacatcatacaccagggcctgttggggtgtgggggggctagaggagggatggcattaggagaaatatccaatgcagatgacaggttgatgggtgcagcaaaccatcatggcacgtgtatacctatgtaacaaacctgcacattctccacaggtatcccagaacttaaagtataataataataataataaagcaataaaagccatatttagtcttatattcattcatgcaccaaaaggcagaaatcagtccacagatcctctcccgctgcccaggggctacaggggtcctgccgggctggccctgtctgccccggggcagacctgtacatcacacacactgccagtcttaatctgtttgtgacacgaagccactgccctccccctacatcagctgatagagtgggaaggtgactgccttcagctttacctctgctcacactgaagcttatttgattggacagtttgagttcactgtaaaataagaaagcactcaggaaacttaagagtgcatcctgccccggagccccgccagcccccacggtgtgtgctttgtgttgaccttgttcaccacacaactctgttctcgcaggttgcccctagcctccccgtgcagcgtggcaggagcagcagttctggaggcatagagtggggattctagccccagcactgtctctcatgacctgcgtgaccgcaggcaagcgattttgcatctcggaatctctgttctccaaagaaaggtaataatacttcgtctttcagggttcttgtaaaaattttaatgatgataaaagaaatcatccaggacagcacctgttataattggcatataacaaattgtaggtatcattctagaaggttctgtctctccatggagatgtgattgcttcttggttaagaagagcatctggaaccaacccaaatgtccaacaatgatagactggatgaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccgcatattctcactcataggtgggaattgaacaataagaacacatggacacaggaaggggaatatcacacaccagtgactgttctggggtggggggagcggggagggagagcattaggagatatacctaatgttaaatgacaagttaatgggtgcagcacaccaacatggcacatgtatacatatgtaacaaacctgcacgttgtgcacatgtaccctaaaacttaaagtataataataataaaaaaaaaagaaaagaagagcatctgacagtggcacatatgccatgctaggaatgcacctctgggtctcttttcagcctccttcttgtgggatggggctttgaagaactgtgcagctggcaggtgtgggggtaagggcagcaggaaagaatttgggtcttctcaagtccctgcccttaatgccctgaagctctcattcttaactcacgtcatagtgttttagagacaaagtgtaacatacataatcatttttgccccctccacagttgggcatgcctaaggatgcccaacatgtctaagaaagcagcatgtctaaggatcagtcaagggtccataagagtaaacatcccatttacttttgcctagaacaaggtgatactgacaaagagtatgggtttaatttatgctttctggatgtggtgagcagaacaacagccccccgctctcaaaatgttcacatgctaatcctgggaaccccagaacatcttactttacatggccaaagggactttgcagatatgttaagttcagaatcttgacatggggaagttatcctggattatctgggtgagctgtaaatgtaatcaccagggtccttaaagagggagtcaggaggatcagattcagagagaagacgtaaggatggaagcagaggtcagagaggaagaaatatttgaaaatgccatgctgctgacttgcagatgcagaaaggggccacaagccgagagatgcaggtgccatctagaagttgggaatgtcaaggaagtggatgatccctctggagtctccagaaggaatgtggccttgccaacaccttgattttaggacttctggcctccagaattgtaagataataaattggtgtggttttaagccaccatgtgggtggggctccttcaacaaaataatagctaagctattgcagtaatttgctacagaagcaatagaaaactaatatatactggataaagatataattaatatattttatgcatttcctgtgtgtttgtgtgtgtgtgtgtgtgtgtgtgtgtgagagagagagagagagagagagagacagagagagagagaaacagatagagagagataaagagagaaacagagagagttgtaaacacagaggtggccgccacagacaaatggtgatgtataggatctatcttgaagtacagaagacagagaagaccttgcccatttattaaacactgtgttccaggaactgtgccgatgcctcacctactgtttccagggacctcctttcccttctatttcctgtttccatttggggagcatccactagggaacatacctccctctcaacccaagggacagggaggtagggagtgccctcttgcatcccctgggctctttctgtatctgcctcctgcaggaagctggagatgtgtctgctgcctccacccaaggaggggcttgccctgtagaggggtctggggttgctccttctgcctgtggctgggtctagcatcttaaagctagaggtgctgaactaactgccacttatgaagccatgctgtctaatccagctccactcaaaatagagctaacattttcatccccatctggttcttgtgcctctctctgtctccccctctctaaccttttctgaatttcagagaagaagggggcttatctattgtaaatccccaaacctatcccctacatgacgtaactgcattcccagcacagcccagtgagggagctatcactgctccatttaacagatgtgaaactgaggctcagccaggtaagggtgacccagctatgagtggcagagctgagatcgagccctgatcatcccaaacatttctactgtcctctgctacctctgggtgagaaggaatctgttttccttccagagatgctaggggagggtgctaagtcctatggagcagggcaagtggaattacccgagaggtgagaggaaatgggagcaccagggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacaggacctgtgggtcactcactggccttgaagggttagctgggcttgaagctctggtccctggtggttgaatctccaaggcagggcaattgaccatctaacgtcccctctctgtgagctcctattcttgggagggacgggagtctgtgggctggacagaagggatttgaccccagcaattgctatggtggtgagaacgtgaatgcagatttcaaccaccccggccttgctttatatccttagagcacatgtgagcatgaaactggacagcatatctagatgcccaacagccggtccatgctcagtaaaaggctgcttccttctctgacctccactgtctttctttataaaaatccagaagcatacaaagtaaggactcaaattttaagagtggccagaaaatgcttgcttttaaaagcttttctaagagtgttggatcacccagtcttgcttctcatcttacggataaaaatctaacctcacactgacctagccattagcccaatgaatgataccacctttctggcctggtcttctttgaactctgacatgagtgattgaggctcagaggggtgaagtgtctcacccaggactacacagctgggaagtcagaggatgtgggctggaaccatagcctccctggtggtctcagtgtggggctccttcaacaaaataatagctaagattatggagcaccacctatgtgaatgaccccatgctgaacttatttatttgagacggagtttcgctcttgttgcccaggctggagtgcaatggtgcgatctcagctcattgcaacctctgcctcctgggttcaagtgattctcctgcctcagcctcctgagtatctgggattacaggcatgtgccaccacgtccagctaattttctatttttagtagagacttgtttctccatgttggtcaggctgatcttgaactcccgacctcaagtgatctgcccaccccaggctcccaaagtgctgggattacaggtgtgagccaccatgcccagctgctgaactttaaatgcatcctttcatctatcttcaccaccactctacagctggggaaactgaggcacggaggagtcatgacaacttgtccaagatcccataactcaaaagttcaatgttgcaagctgcatgcaggcagatgaccccaagcctggcactcttgaccacagttcagggtggccatatggagggtctcttctcagctttctccctgttcatcaggacatagcaaactgctgcagtgagatggtctccacttttatgattacagagcattttagattcttccaacttgatctaggaagtgatttcaggagaatcttttcaaaaccaaagttattaataactgcttctgaaattataatttgagactttgtacaaaacttgatttgggctccagaactcctaatgatggttcaacaaatcagatggaccttcatgtggttccaggccaaaagagggggaaagtaccacagttttctgtaaacacatctaaagttttcatgtctccttccccttgttcctcccagtcacctcccttccctcccttctactcaactgtttagagaaagcgtaagaaatctgggactctcttaggcactaaggtgacagcagacaacacaggtcctcgtctaccctagaagacctcttagtctagcaaggaagggaggagtacacaacgatttcccaactaagtggttagaggaacacaccaggaaccctgtaatgcatgggtatcccaccaagtgcaaagacccaggcagcagtccaccgccggtgagcacccagaaccaatgtcaccaggcccatatggctcattcacagctggcactctgatcctctttgctcttcttttacatctatttctaacacacttgggtgtcttgtttcccaaccaagactgcatatcaggaagcagcagattttgaaactgcatggcattgagagaggagaaaacaatgctagaaacagtcgtgctgatgacagcaaggttgggaggagattcatgcaagctgagcagctgccacctgtgagatattttacataattccacagattcctcacagcagttgtgcaaactgagtattatcatccccatttttcaggatgggagactgaagcccagggaagtgactatgattggcttctgtgtttaagaaagaaggaatcccaaggaaggaagggtcatcccaagtagataagagaaccaccatgaccctgggcattctggaagataagggaaggttcaagaaaatgaaggcttccccacactgggcttgacaattggtattgatccaattttcagcccaagaactccctatctcctgccctcacctccttttctcccccagacactcaggtgcccaccatgtggcatgggctgctctggtgctggaggcacagggttgataagatgcagcctccatctcccaggatggagacccactaatagctctctccaggtgaggggagcacagtggaggggcaggaactgctgtggccaccccagcaatggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttatcccaacttttgaataatttcttttttcctttttttttttttttttttttttttgtgatggagtcttgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtgctgggattacaggcacaagacactgcacccagcaaaattttgagtgacttctaaagtacgtgaaaaacattcatcagctccttagcataaatatactgagccatctgtgatgtttgcttgatacagaggttctcagccaggggcaattttgctcccatgggatgtttggcagtgtctggagccatttttggttgtcacagctggtggggcagatggtgctactggtacctaatgggaagaggccagggaggctgctgaatagcctaggcacacagcacagcccccatgacaatgaattttccagctcaaaatgtacacagatatgaggctgagaaatgcaagtttggtacaaagtgtctgggtgggctgtccagggagtgcacccaacaccagcaggtgtgactttgtctgtgcaggcaccacccctgggaccttgggcaatgcctgaccctctgtgagtcacacgtccttcatctagaaaatggggacaataccacttaccctgtggggctgtttggggcttgaataaaatgacaaacacagagatgcctggcagtatttacggatgtctccagtgacatgtcatgtcccccaaataatgtctgggataatgaagaagacaaagcaagtcttccaaggcagctgaagttttggatcccaggggtggtgcctgcacagaaaaagtcacacctgctagtgctggtagctctctttgtcccgtgaatttggatgacaaggcagcaggtacaggggagagctggaccacagtgtggctgtgatgctggcatttgccactaaacagcatgggtctctctgtatgtaacacggaagaagacttgtccccatggctgcctagggatggcctggggacacagcctgagtgacatgcatgggggtgctctgagggggaccttggggccagatagctagggctcaaatccttttactattcctcactgtttgaccttggaaaagtttctttatgtctttaggcctaacagtgcggcctaactcacagggcagccatggggacagctcctggcccactctgagtgctacatgcatgtgcacttgatgaggtttgcagcccagtaggtggaggccaagtgacggggagcagctggcctgggtttctcactgcaggtttgtgtcccactgagatgggaagccaggcctctgactcttggtccagagctctgctccaggtcaggtaaagcacgctcagctggaaatattatcccgacttaaagattgaagatcatcaacatgggagggcagaacactctgaggatggggcctcatgactgctggctttgggagcagctgagattttttttcaacaggtgcttagtcagtgcggcttgcaggtacaccatagaggaatttatgaagttatacgggggatgcaaatggaaaaatgatgtccctgtggagaattgaattctgtttagaactgatggttctcagtgtaaatgcctcattcactacaggttccatattcggtctttaaggcttcaggtgttagcttgaagaaacaattcacttcccctctctactctctgagaacaagcagcgcctccttcagactgtctggcaaaacctcggtctcgtcaacaggaagagacaacaggactctcccaggatcactcagttaatgtaggtacagccactgacccaggcgcctgctcaatctgctgactttaaccagaccaaggagaaaggtaaaagcaagaagcaaggtgatctcatttcatcccagtgtttccgaaaatagaaccaacagttgttgaaaggaggtggaacaacactgtggttgtagatttctatgctgctgtttttccttctctggacaggaatgactccccttcacatcaccttccctagacacccccaaacaccctccctgcccgccttggggggtgctggtctcacgcttatttagtataaatgcaagctgtcttactggggccctttggaagggtgctggcgggtgccccttctccctctctctgggttcagtcagtctcctcccaagtgacatgagtgacctcagaggcagtttggatgctttatgcaagaatctcctctacgctcccctgccaagtggttggccagcctatttgcacacttccatagatggggagatcaccacccctagaggcaacccactccatttgtcagaagcaacagtaacagtaaagatccagactctgcctccctaagtctccaactgggaattccacctttgagtgccctcaagggagaggagactgctgtgaacatccaagcatctggggaacctcatggagagacctcctcagacttccctgcctgcagcagctcaagccccagaacatttcttacttaaagccttgaggtttttttcaagccaaagttgtgagttgaagacagcccagtcaagagtacttttatgaaaatcatctgaatgtctctcacttctgacttcctaatatcaattttttaaagaaatataacttttagacatgtctaggaataattagtgatagcatttattataggatatctctgtggctagcagctgaactgaacactttgcatggattgtgtctttccatattatgtgatcccattttacagatgaggaaactgaggatcagtcaagttacatggttacctaacagcatagagtttgtggcaatgacagaactgagatttgaacctgggcgtctggggcccaagccctgaacctccccaccctctgatccctccagtcatgcaaggatgcccaccgggccccaggactcactgcattgaggccacagagctggtagcaggccatggtgacaatcacggtgaccacctgccagcggacgtagggagctctcagcagctccagcacggacaccaggcggatgctcctctgcacgcggctctcagccaggacctcctctacctcttgggaaacgtctgctttacccaagaacgtttggaaggctgcaaacagaggcacacatggactttcagcagggattagagtgtccatcatgtctaatgctgggccctgcagggacgggtcccacctcctagccacacaccttagctgggggcggaacttggcaggggcctttgaaactatggagtccaaagcccttgtttaaaaatgggaaaacagaggcccagagagatgccatgatttgctcaacatcacccagctggctgggagaaaagctgagaacgtgggtctcttgactgtccgcaacgcaaggcagagcacacccagagttcaaacccgtctataacattgggcagttgtgtccctgttcatcttttgttatcattcctgcctccaatggctgttgtaataattgcatgatatcatatacattcaaccatggctcggagcttcccacactggagttcgtttgctgaatattcactaagcacctcctgtttgcctggctcatgagttcatcctcattgcaggtgtccggagaccagtaggatgtcacttggccaggatgccctgcagtccatgctattgtgaaaagaaggattgagcttaacgactgcaaggccccttccatgtgatcctctgaaatacaagaaaacttgagtggaaatagtcccaaagagtgaatcttaccaggactcaaacccaccctcatgatttatgccttttccatgttgaacactgcaaacttccagcctcagagaacccatcattttttttttaaatgaagaccttaattgtgcaaacctctatgaatgtgtgcttgaaggcgggctgactgattagatcccggaaagcacaataatcagatcatggggtgcacttttggacacagatttcaatgctcagtgctctgatctttcttcctcccacagggaaaggtggctattgtgctggctcctgcggacagtccattccagacacagcaggcagcatccctaaaacatggctccgcccctcagggcgtgtgaaaatgctcttcttaagcaaatgccattaaacttgctccagattctccaagaagcaagaacccttccgaaggctttggagtgttatttccagcagggtactaaaaactgcttcagaatatctttttttatgaactataatttaatgctctccccagcatttattaagggtaaatgagaaaagcagctgaatgagcaatgtttctgtttcatgcattaagtataatatttctactgtttcctcaaagttcaaaatgcaacatctatgtgataaaataactctagacttctggggtagaaaactatttctttccttcatgacatacatattttccattataaaataaggataacttcataacctatgttttttttttctcttttcaccatggctgccaggaagctctcagacaaatgcaatgtttagcccttaacagaatttcctgaaacaaaaaatctctcttctttctcttaaaatttcctatcttccagctccatccatgtccctgcaaaggatatgatgtcattcctttttatggattcatagtattccatggtgtatatgtaccacattttctttatccagtctatcattgatgggcatttgggttgattccatgtcattgctactgtgaacagtgctcagcaaactaacgccggaacagaaaaccgaacaccacatgttctcacttataagtggcagctgaacaatgagaccacatggtcacagggaggggaacaacacacaccagagcccattggggggtggggtggggggagggagagcattagaaaaaatagctaatgcatgcagggcttaatacctaggtgatgggttgataggtgcagcaaaccactatggcgcatgttgacctatgtaacaaacctgcacatcctgcacatgtatcctggaactttaaaatttaaaaaaaaaattctgatcttttcttaaagcttcaatttaaccttcctattgtatatatgttcataaagtgggtgatactgtttcagagtgacccccagcctatgaatgagcaaggaggcagtccaagggcccagccatttctgtccagtgggggacctcctgcaatgcatgagtttctcctgagtttctccagagctctcccctggacttgccaagactttgccaggggcactgtggcctgatagctcctcctgcccagttcttctcccatccttgtcactttccatgtgttattctccattgaaacttctgctctcctaactcgttctcagacctgcttccaggagaacccaaacctgcaccaaggagttacctgccggcgcctcccacacccttcagcccctgcctcttcagtgccctgcaggaccctggcccaagcgcaccagccttctatttccctaactgccaggtaagtccgccccccacccctccatgactccctcactattttcaatcactcctaacaacggcctgttgggatttgggcttggagtcctccctattccacatgcaccctttctggctgagggctcacagatattcttttgaaaatagcaaacatagaagactgagctggagtcctgagggggcaccaaggagggggcatttcaggctgccagagaaggcaggggcactctgggcaggaggcagaaggatggaaagttgtctcctattcctggcactagggaaaagcaagagacattctgtaaggtacatggatgtgctttggtcaaggaataggccgaggcaaacatccaggccagaatgactcagtgagtttaggtgcacaggtgcatactccacttgttatataacctgtttgtgtaagttcatacttggcttggagccactattgtttgggaaggtataactgccctgctgacactgtacgggggctcttgggcatggctccacatgactcttgtgcagctgctggcacccagagaaagagaggagagggataaccagagccgtccattttgcagatggacagaggggagccagggcagggttcggcacagcacggcatggcacggctcacgcttgtgcccagagagagaaagagttaagctgctgaccctgaaggcaagggagagctggccgtgcagctgagcgtgggagcagctggctcaagcagctgagacagaacggacagtgtatgagagctgctgatgagagagctgctgagtaaaaccatattcacctgcttacggccccccgtctgttttttcagctacctgtccatccatccaccctccttgggcctcagttggggctggaacctgacacattcatctgcatatctggctctttcctcaatctggaatgttcttttgacctttctgcacctggctacttgcctcgttctttcagccttatctcagacacctccaggaagccttctctgatgctttcctggctggacgacaagggaggagcaagccgaggagggccttgagtgtttgcacggagatgaagttcctgcccacaggtcacagggggtggcaagacctatagttctgagacccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacacccccaggagcagccctcggttaagacaaagctgatgttaacagaggtatacctagcttcctcacagacacctgagtgagtcctacgctgtcccccagaggtgactgggtgggtggggtcccagttgcccacagctgacacctgctcattattgaacctcaatgcctcctccacttccctgtgccatttcccagctggggaagtgatgcttcctcaattgtaccctctccttccctgtcccatttcccagctggagaagtggtgcttcctcaattgcatcctccatttccctgtcccatttcccagctgggcaagtggtgcttcctcgagtcacctctcaaataaacttcccatcttcaaaaccttgactcaggctttgggggcacctgacaacaatcacaaagtcacctaaactggatgcctgtggtcacataacccagacactgccttccgtgtctgatttgtctgatctagtgactaagccccttcagcgtctacagtccatgtgctcctctctgcctgagcccaggcctgccttagttcaggcctcagcctctccccactgggctcattatccccaggctaatccccaggaagatgattgggccactcttctgcacacaaatctgtgctgtcttgcccttgccagcaggatccagtccaaattctcatctgccatgcagagcctcctcccacggtccctgtggcatctggaggctccccccatctctcttggctgctgccctggaaaaggcactcgtcctccattccacatacccccatggccttgcctctgtgccctgctcgtgctgttccttgtgtccagaacaccctgccactttgttgcctgcctaggacatccttttccgaggatcccctcagcagttacatcttttggagaccttccctgcccccatgatggctaatcactgttaccctctcatccgggtcgctcttgcacctgtgtctgtctctcttgtgcactttcactcttgtctggggcgttctgtctgcacacctgctgtgcccacccctgggagcgccccctgaccaggggccatttaagggatgctgtgttactgtggaaaggggtgggccttggagtcggagcaacctgggcttcacacccagccctgtctctgctaaaagaccccagactagttacctattctgcccgccccatgcttgttcttccatgaaacagaaataataaaacctacctatgaggttgttttggggaataaaatcaatgtgtgttaagtgttggcacataatttgtgttcaataaacaattattgttattttatttcctctctgttgagccttgcatagaatgtacatccaacccatgtgttttgaatgaaatagtaaaaatcaagactcaggtgacagggaaggagaaggagcatgttataaacacagaagcgggggagggctgagcaaacaggaacagaggaaaattatgctagatgtcaaccaaattgcatcagcaggggggccagtatctgttcggtgttctccctactgttccgggcatggtgtgattttccaatggcaggctccccatggtcctcagacaccttcagagcacagcagagtgacagacactgatgcatctgggggtggcccacatacgactgcaagcagatgagatggagcccgccagcctcccttggggtcctcagagagccacgctgttagcacaggtgccatcctggcctggagacccctccaggtgtctgtacacctgctgagcccacacctgggagtgccccctgagcaagagccacttaagggacgttgtggtacagtgggagagggcaggtcttggagctggagaaacctgggcttcacattgtctcagggccaatgggtgctcactaatgcaaacacacattgtctcaggaccagtgggtgttcaccaatgcaaacacacattgtcttgggccaattggtgctcaccaatgcaaacacacattgtttcggggccaatgggtgctcacaaacaaatcctggctgcaccattttctatctagtatgataccaggtgaagtatttaatgtttccatgcctgagtttccttgtctgtaaaataaacataatagcattggtggtgtaaccagtgttcgatgttggcacacacaaagtcctcagaacggtatctggctcttgatgagcaaggagcattatgaatatacatgctatcactgtggggtacttgctacattctccctctccctttcatctttagcctggcagagggtacaaaatgctataaccttctgttgtgggttgaattgtgtcttcataaacatatgctgaagtcctaacccctggtagctgtgaatgtgaacttacttggaaataagacctttgtcaatataattaatatgtaagttatgaggaagtcatactgtaggaggatggactctggatccaatatgactcttgtccttacaagaggagaagagacacagatagatacacacagggaaggcaagcttgtgttcacggaggagaggttggagtgatgcagctgcaagccagggagcaccaaggactgctggtccccgtcggaagccagaagagggagcatggccctgctggcaccttgaccttggacttctggcctccagaactgtgagggaatccatttctgttgttcgatttttttttttttttttttacagagttccgttcttgttgcccagactgcagttcagtgatgcagtctccactcactgcaacctccgcctcccagattcaagtgattcttctgcctcagcctcccaagtagctgagattacaggcatccgccaccacgcctgtatttagtagagatggggtttcaccatgttggtcaggctggtctcgaactcctgacctcaggtgatccacccgcgttggcctcccaaagtgctgggattacaggcgtgagccaccacgcccaaccccatttctattgttgtaagccactaactcatggcactttgttatggcagcagccacactttgtcacctcttttatcacctcctgctagagcaaagcgcagaacaacccggaggcctcttccctcttgtgatcgggggcctgggatgagacaggcaaagggacttcacgtggagcatagggcaatagcctcgtataagttccatgcccagagtggcactgagcttgttctcccttacacagggcaggcctcatgcttctaaaaataggagatttcatcaaagcatttatttttcaatgactaatggaatttaagaggaggaagtcattgggtttttaacttaggttcagtgtgtttttattaccgacagcagttggatccaaggtagggtatgtaacaaggggtgtaggaggagatattggagctcctatttatagctttataacgttttattatggaccgaacctggagccttcacatggcctatgtgactggggatcagggctccaccgtgtggagaagctgacagggtgccttcgatctgtcttttgaatgacatattgctgtttacttgtgcaatttaccagttagcagatttggaaatggtagtatttggtttcaattgaattaaccccaatgaatatacaggtggcttgtaaagaatccccaaaagctgagcatagtagtacatgcctgtatgtagttccaactaatctttttgggaggctgaggtgggaggacctcttgagcccaggagttcgaggccagcctcagcaacacagtgagacctcatctcaagaaaaaaaacaaaacaaaagaaaccacaaattaaaggtaaaactaacaactcccacacaaagaaagacaggacaatcaatagtggaacccgctatctccatttcaggtgcaagcctgctgctagcctcaatgaccattgacagtacgctgcctcacagagattttcaaattcaagatgtagtcaatctgttgcttcaggataaagatgacattttaacaggagtgagaaagtagcaaccttttataagaaactgttccataaaaagagatgtgtctgtcatgtggtttggtagacaaagttatatacacagatcaccaataaaaactcttggatctcagctgggagcagtggctttcgcctgtaatcccagcactttgggaggccaaggcaggcagatcacccgaggtcaggagtttgagaccagcctggccaacgtggtgaaaccccatctctactaaaaatacaaaaaaattagctgggcgtggtggcgggtgcctgttgtcccagctactcgggaggctgaggcaggagaatcgcttgaacccgggaggtggaggttgcagtgagccgaaagtgcatcactgcactcccgcctgggtgacagagcaagactccttctcaaaagcaaacaaacaaacaaacaaacaaaaaactctcggatctgcacattcaaaaagaaaaacttgcaagcagtttaaaaaactttctgtttaaacatattccgaatgaaaagtttcagtaggttttgctaaatgattattgttaaaatataaaaaggcaacaacttcttactactcagcaaggacagtggttgatactaaggaagatggaaattcactggcctgcattttcaactcccaaaacatttcattcctgatggacgggattacaggttgaagccgcttcatcaagttcagccagccttgtcacctgcttctgtttggagctacatcgtttaatgaggttcatttttgagctatccacgttgcaataacattggtcaccacttgctaagggttcccttgtgttttatgtgcccttattcatttaattctcgtataactatcccctgaagtagacacagtcagtattcccactttgcaggtgagaagatgaagcttgcacatgggcagtgacactggatgccctcgcagcagagcctgagacacatgctgggtgtgggaagtttaccggctggagagcaaggcagtccaaggtgcatcttggggagacttctatgggcaaagggcatcagttctgcggggcttctgagcagcacatggaatacctccagaactgtcccacaggggaagatggggcatttatctgccagctcctgcccccaggggtattaactccctgaatgtctacactgcgctgcagatggctgagcagcttcctggccatggagagggcctgagcatttggagaggcacgtgctgtgcttaaggtgggcaaacattggcccatacctgagcccacatggactgtctgctgcagcaaggctgaaattagagtgggcagagggagggtgtgagggggacactagaaggggctagtgctgtcattcagcaggggagcggaggagcgagaattacaacccacaccggggctccagaagtatcattttcccaatgtccagcaatgcttcctggaagctcagccagctggggctgctataacatcatactacagatgggtggtttagacaacagacttcacagtcctggaggccagaagttcgagaccagggtgtccgcagagtcagctccctggtgaaagcctcttcctggctgcagacactgccttctcacttctctggaggcaccaccctcatgacctcagccagccctcccaaagactcccctccaaagaccatcactctggggagctggggcttccagatacaaattaggggtggtgaggagcacaaacattcagaccatgacagcaacttagaatcagacccttcagagctttggaatgctgtcctccccgcaaatcctgcctgtctctctcccctcccctctccttcctcccttccacctttcctcctctctctctcagtctcatctgaaattgaaagacactcatcatgctctctggttttcacccaaccttcccttcaccatcactttcatcagagcaagacggatatctgtgttgcaagtttagcaaatgccaggtcttcccctaaagacgggtggaaggaaatgtagctcctcacaggcccagggtgaaaaagagggtaggagggagagccagaaagtcctctctgtgcttccaacatgtcacagaattggtgctaaacttgcaattgcctgtagtgcagtgttgggggtgtgctgtgattggtacgtggccacacctgtgctggctcctgtcctcacagtcctgtcagctcggggcagcgcttgcactaggggaaggctcatggcagatgcttcatggaagaggttggttttcctctgggtctagaatgcagaggtgctcacagcatgctggatgaaggtaatgaacctactcatatttgcagatgtctagtctgcagaaaagagtttcccaagaggagatgcctggattggatttgctttccttggctctgaggtcagaacaagggctccaggcaagagctctgatgtgtgggaccacaaggaagaactgcctgatggatgtgtccaaggatgaacgtgttttttgcacagtgagttccccatccctgaaggtgtgcaagaggagccaggtgaccacctgtcaatcatattgtggaagggacccaggcactggagaggaagatgaacaacagggtctctaaagcaagcccagaaccccagatgtgtgcaggctgtgtagatgattggaaggagatggggcaatgtcacccatggggtgggaggggacagagctgatacctccagtttaaactggctgcccttggagagagaggaaatggcctgggaaattgctatctatcagcccatttaaaaattacatgagtttatggaaggtaactctctcagaggagttcattctcttcactctccaagtcatttaaaaatagttcatccaagccctaccccctgaatgcatgttccccacattctcccttcaatttgaaagtaagagggcttcctgtggctcatacctcatgcatattcctagccatgttctaatcactaactccaaagaacttgaaagaggaatgagaaattgcatttcccaactgggaaaaaaacctctgtgtagcatggcaaactcctgggctgggagagggagctgttacataatcagatcttgccccagttacagattcaactttattcaagaggagtcaagagacactgagcaggggagaagaggctaaggtttattgtgtacctactgtatgccaggctttgtgcgaggtgtcttacagaaacagcccttcaaggcgagtgtgtttcagtccacagcttcagggaggtgaggaaatgtgccagtgttcgcccaggtaatagtgaggagttcatgctctgacctagatctgtctgatctttctttccacacacctcacaagaaatctcagggctgagaggctaaggagccaaattcagctcattgccattatccggcagcttgtgagagcttgctgtgcatctgggatggcgtgcaaagatccactgtgttaagggaagaacaaggaacgggttctgctcccaggaggtctctagtgagagacagacacgactcactaccacttgagttggtggggcttgatgccacatggagagtgactgcagggagacctgaaatgagaatgactctctctctctctctctctctctctctctctctctctctctctctctctatatatatatatatatatatatatatatatatatatgccttgcctgacttggaaaatctctctcatgaggaaacctctccagaacagaggtagaaactatcaagacagaaacatcacagaaggcccaaagcaatgatctaaaatatttcccttgtaaaaatggcactctctctctctttctccatgcctgcttctcctctgggtgaaactgcttcatgttcccacagcaagtaagtctccatccaattgctataaacacctccaagaatgtactacagagctttaagcagcagcgtgctacagactgtactcagcctttggtatactttggttttcttcattcatgcaacaattatttagtaagtaaatgcctactgtatgccaggcactgctctaggtgctggggtttcagcaataagtaaaataggaaaagtgtccctcctcgcatggagcttttcattctcatggaggggagtgatactaagcaaattcatttataaacatatcatttcaggtcataatgagtgctaaaaagaaaaataaatcaaggtaagtggcagtgagaagaggggacactgagctatggcagctgggggagatgtttttgagaagatgctatttcactagagacctaaaggaagtgagggaggtgtgggtcatgcagacatctggggaaagagccttccaggcgaaggagccagtgcacaggtgctgagatgaaatgtgctgacagcatcccactacttatgaacttgttgcatttgccctattgggactcagccccacaaccacccttttagaactcttctgtgtcatgggggctagcagcctacaaactgcctgtccttactccctataaatgatatctccttactcccatgctagcagagtcctgttagattccagcagtgagaggcactgatgcatcgttagaggaagaaaggacctcttctgctagtcaaagttccagcaccatcagctgtggctcctggttagcctcagaggctgtggttcccacgtcatctgtgccaagaacatcagccacgttaacgagagcagctccagcatctgccctgctgccacagtcatgcttccagcagtgtcagtaagagatgggatcagttcttgaacccaaactcacctggcatcaaaactggctctgtaagaccacagaatctgggatatgcatggtgtggcccaaaaaggaggacaaagtttgacacaaatggaatgtgactggaggagagtagctgaactcagcctcggcaaagaggagcttcttttaggcttcagaaattagaagtgagccaatgccaatgcaactctttcattttgcagagaggtgagcactttgaggccactgggcaggccagtggctgagctgggactgagccctttctcctggaaaggggagggagggtgaacgcacgggctccagggtgactctgcccaactccttttgctctcccagccctactggcacctctgtaaccatttcctggcatccagtgcctctctgaaatattatttccactttcctgggtggaacattgaccaatgcactagctctgtgaccttgacatttcctcgctgagtcttagtcttctcatctataaagcaaaaggtagaaaatgtgtagactttaggggggtgaggactaaggtaatggttgccatgtacctagctctattcacttcctcttgctgctacagcaaattacaatggagatttatcatcttccagttctggaggtcagaatctgaagcaggtgtcactggattaaaattgagtgttgcagggctgtgttccttctggaggctctagggagaatccgcctgcttgtcttttccagctcctatggtccacctgcactccttggctcctggtcccattcctccatcttcaatgccagcaaccttgggccaactccttctcagattgccacttctctggttctctctctctttgcctcctttttccacttataagaacccttgtgattgcattgggcttaccctggtagtccaggactactcattccaaagtcagctgatgagcagccttaattccatctgtgaccttaattccatctgtggccctaattccttcatcatgtaacctaacatattcacaggttctgggaagaaggaagtggacatctttcagggtggggtggaggtcattattctgcctcccacactagcatataagaggaactcaaacaaaggaagccatgagatctcccaatcaaatcccctctttgtacaaagcaaaattcacagctttgtctgcccactgtaccactccacctgggtaagcacaaaaatgatgccaagtagatgaagacactatgtgtctatcgggaccactggagcagatgcttccctgggtagctggacactttcttgaccacagatggcttttcattttttctcaaactactttgccctgcttcttgtgtcccaaaacagctatgtccctaagacactgtctgatggcagaacaagaatcctcactgttcttggaggaagtttccatcctgacagaggtctgggattgttgctggaaaggccctttggtaccatccagcactatcctagccatgagcagatgaggaaacagtcatctggagagatgcatgatggccagttagtagcagagctggatttaccatggggaattttttaatttttattttactttaagttccaggatacatgtgcagaatgtacaggtttgttacataaataaacatctgccatggcggtttgctgtacctatcaacctgtcgtctaggttttaagtcctgcatgcattagctatttgtcctaatgctctccctcccctcagcccctgcccacaggccctggtgtgtgttgttcccctccctgtgtccatatgttctcattgttcagctcccacttatgagtgagagcatgcggtgtttggttttctgttcctgtgttagtttgctgaggacaatagctttcagcttcatccatgtccctgcaaagaatatgatctaattcctttttatggctacatagtattccatggtatatatgcaccatattttcttcatccagtctatcattgatgggcatttggattggttccatgtctttgctattgtaaacagtgctgcaataaacatatatatgcatgtgtctttacagtacaatgatttatattcctttgggtatatgcccagtaatgggattgctgggtcaaatcttatttctggttctagatccttgaggaatcaccacactgccttcctcaatggttgaactaatttacattcccaccaacagtgtaaaagtgttcctatttcttactggggggttttgagcccacttagtgctcattctgtgctgtctcactgtccctcggagggggagcaatgacacttacaaccacctgctgtgggagcctatgggtggtggcagagcccgaacacctgcttccaggagccttgggcctgacactagtccctgcccctatgtgccctggttctgacctcagaacctggagctgagctggttcttagagagcatcttgttctacttctgatggtgcaggtagagaaacacagcccagagaggtgttgtgaccaaaccagaactcctgacccctgcccagtgtcaacactcagatcccacagtctctctgcacctgctatgtggaagaactcaacaagattgctgtccaagaagtcattggtgaggaagcccaggagatgctgcatgttgttttaggacgtgtgcccctgaacatatgctcccagcaccgtctcgcctgcagatgcacccagtcaaacctgatgggtcccaggacctcacgctgggggcttaacagtttccattccactctttcctgcaggaagctctgtggctcataaaacattaaaatgagcactgctgccatttcatgaaatgcccagcctgtgaagaatgggttaagggatttttgggagctgttgtgtctgaacacaccaggcacatctgggaggcacatctatgaatctccttcctcattagcatggcagctcttcaccctagggccccagatggggcagttgtcttacgctgcctcctgcgagaaattggagcccttctgccaaaataccattgctatgggtggaatgtttgtgccccccagaagtaaaaagttgaaaatgaatccccaaactgatggtatcaggaggtggggcctttggggaggtgatcaggtcgggggtgcagaatccttacgaacaggattcatgcctttataaaagagaattacaaagcactctgatatccatgatctgatatgatcatttctctgggccctagagataagcattcacaggcaagaaaactgagcctttgagataacgggcagctttcctgagtcacacagctgtggtatggggaagacggggctggaccccagctctgctaactctcagctaaccctgggccacatgctgtgacacacagtaggccttccagagagccagggagcatgatgatactagcagcaacattaccaggtacaaagaggggaagaaaagtgtgtcaacttcacggctgacaccagaatgtttctcaagcactgtcatggctaagaaaaatatttagatgaatgtctggagcagcaggtgtctgctgaatgtctgcatgtgtgctggttccagctacagaaggggcgggaaggcgctcgacatgctagagggaggagaaatcggggctccaggggcatctaagaaagcagaggggatgatgagcagagatgacagggagaggaaagaggaggctgtgagtggcaggatggagtgactcccccaccaccctgaaatctttgatatggtctctaaactctctggtgatttgttgtacatgggtgctgttgtttttgagaaaaccaaagaaggtactgaatttcaagttgggactatcatgtcatcccaagagcaacagaactggtccccaagaagcagaggagactcaaagcacagggatgctctgaatggtaaagaaatgttgaacttccttccctgtgctgtggaattgaaggtacgttgagaacttcctcccagctctcaggggcacagagacctccagcaatctcaaaggttgcacgggaatggcacccatcacaggcacaacatagaaaacatcctctgcttcagcaaaaccctaagcaattctctaaatctaaagtgaggctggtccttacagcaagagttgcttgttctttaaaacgaagaagtgtgtgggcaatttctaggaacgacttcgtgctctgagggctggaggctttggtagggtggtttccgagctgtgttttcccgcccctttttggcccttgggttttctgtaggagacatttatctctgtgggcctctgtttcttcactcagcaccctgtcccaacaagttctctctagccagggaaaagggagtcctggggcttagctagtccatgggccaaaatgagaagactctcagaggccacctatcttggctcacatcttagaaatgaaacagagtaacagtgagggaggagggcgctggtcttccgggagcaggtgactgccagcagagaccgagagaagacctctgaggcagtgcgtccccacctccctctgcccagctccctctgcccggtttaggagatggggacatctttatcattgacaagggcaagcatggaacgttacacagcccctcttctctcctcagccatctccagatgggtataggtgagctgagggcctccaggtaaggccaccacagacagcagggcctgaagagccagctgatcaccccgtggcctccttcctgggttctgcgttggttgttggtgggtgtgtttggtgcacaggtgagggagtaagcgaggagtttacctctgttgcccctccctcagcaagagcctacaaagcacaaagcccagctccctcaagcatcagcggcctccgtttgtgcctgcatttacctgggcctgcccgtatctatgatgtccacacttctgtgatcacacagattctttttatgttctctttgttcccccccgaacattatgtcctaagcatgccttcataatgctacaatcatctataattgtttgttaaataagtgaattaaattggcattgggatatcattttcagttttaagcagatacacgattacttatctaactgttcttagatgaaatggatgcaaatctggaatttaaccctggcttaatatataaagtcataatatttcaggagaaattttctgtgtctccaacccatggattaatgatcttttgctatttttttttttttttttttgagatggagtctcactctgttgcccaggctggagtgcagtggtgtgatcttggctcactgtaagctctgcctcccaggttcacgccattctcttgcctcagcctccagagtagctgggactacaggcgcctgccaacacgcccggctaattttttttatttttagtagaaacagggtttcaccgtgttagccaggatggtctcgatctcctgacctcatgatctgcccacctcggcctcccaaagtgctgggattacaggcgtgagccactgcgcctggccgatcttttgctattatggttgtctttatgtgcacgttatgtcttataaataagagtcacacacacgctcaaggcagcaccctgcacttcagtgaattcaggtttgaatgagacaaactgagttagaatctcgcttctgtgatgaactatctgtggtatcttaggcaagctactcagcctctgagtggtcatttccttgtctgcaaagttttggagatcacagaagcaaagcaccatgtgtattgcaggcactggaggctgggattctcctaaactgacaagggtggcataaataaataagacccagggcctgggactcattccctgccactatgaactgggggtggggatggagtggggataggaacatcccgaaaggggcctcttgtctgaagtgattgtgttgatggcccaagttcgtggcctccctacgtttatgtcctctaccctaaaactttgaagccccttccactctgactttgggttagctatgtgacttactttggccaataggattttaggagatttcaagcttagagaaaacgcttgtgttttccatttcctctctgattaccatgagaatgtgccctgctggccagctggggatgaggtgcattgaacagagctaaggccaacctaggtcagccaggtgaccaacagacatgcgagtgaacttcagctggccccaagaaagattttaaggtcaagccctactaagattaacagaacaacactgttgacctataggtttgtgaactggggcatgctattatctaaagccaatgtgttttgggtgttttgttatgcagcattattacagtaatagttgactaacacagggcctcttttccccaaattatcaacagactggagaaggggtatctcccacagtgccgagcatggtgctaagtaataaagtgcattttgtttacattcataagttccagagccagactgtcagaattcaaatttcggtgctgtcattggctagctttatgtccttggccaagttatcccatccttggtttttttttttaggtcttaaaatgggaataaaaatattacctactttctatggttgttgtgatgatttaatgagctaatgtatgtgaagtgcttagaatgaaatagttttcaatacagatgagccattagtgggtgtttctgtccatctcccttaactagaccttcaccctccctcactcctggggggcaggaatgtcatctcataccactgtctcaccctgtcacctggcagaacacccaacatgctaaatatccattgcttgctgaatgtctggagtaaaattagcacttttataggtacagatgaaaatttcaataagctatttcaacttaaggccaatatctttgttctttttatagagtgcacatgtaatatttatcacgttttgtaactgtacttctccctcactccctactgtgctatgaaataaaactttaaaaccttcttcactgtctggcattgacatgcactattcattccaactgtacttaattgaagcatttctcaagagagccagagggggtgcgggttaccctcccaggctagtagagacagagctggaggcctcaccctcttccaataatgcacagcccaggtgcatctagaatcagatccccttggttctctctcttagtcaccttctttttactccagagactctgccatctgacaaccatctgaaccaaacttttaggtggtttttctcctcactggccacatgggaagtcacccggtacaatagccactacttccgtttcctggtatctctctgtgcacgaggggtgttggaggaaaatcttctttgggttccaatcctttggttactaacgggtttaagattgggggtgggagttactaaccagggtcctctggagaaaagagggctcaagtcccaggtctatcaccaagccataggcagaattttgtgtatatggttactgtattgaagaaaacactatcatttccatcatattttcaaaagcctctataaatctctataaaccaaaacccacagctttgggaaacggaattcatccctgtaagcctcagtttcttcatctgcaaaatgaaggtaataacaattaccttctctgacttcactttagagaaatgttataaatgagaaaatgaatctgatccataaactgctagacaaatataggtaattgttaatatttcattatgccatttgttaactcagaaaatacttaggtagtgtgaatttcaaaagatgttgcacaaattgtatatataattctcaagtcttttcctggatttggacatagatgaaatttagaactaaaatgcacagagttctcagtaataatgatagcagataatactacgaaccttatatgcaccatctaattcagtcctcacaatggccccatgagggaagtttatgtcatttcctttttacagatgagggttctggggctcagaaaggtttaaaaaattgctcaaggtcagacatcagagctggatgtgaaggtagtgctggttaccttcacatgcctaactaaccatggtgctgtcaactgcatctcattttataaaactaaaagaatcagaatgtgattgttcattctgcattgtctatctctaggcaacataattttgccttttcagggctctgtagagagatgtctctgattccgaaagccaagatttgaatctgactcagcatccccccatttagggcatttaaagaaagctacatgagacaactcccaagcccctttgcgagccttatttttctcccctgtaaaatgagtgtatactccttcctccctcgaaggactgttggcaaggtcctgtgggtcattgtgaagaagcactcagaccagtgcctggtgggatctggtgttcactctgtgcttgcatcttttcctctcctggcaggtaaatattaagacagaggaagtcagtgaagggagaagaagtggaaggagggccgccatgcacctaagccactcagaaatttcagatggcttcatctctgtggctgggaacaactagagaggtggtagtgagacactgcacagaagtgagggaacctgcgtcttatcttgtctgttctggcttttccagattccctgggagactccctgggtgactctgtgtcccctctctgtcccccagcaaggctgttgggaagatgaaatgagaaggtaccctatgatacccagcccagtgcctgcaaaaaggaacaatgacaacaccccttcctgtgcccattggcccaggtcccagcatgccttgcagtgatgatctatgcaggggctggagctgtgcaggaaagggaagggccctcacctttcacagctcttgcctcgttgtgcttctccaagagcaggtagcgtgggctgtccgggagaaagggaaggctcagcagctggacaacggcagggaccacaatcactccaaacaggtatggccaggtactctcctgtgggagaaggagatgctgctgagtgcagtggcctttggtcattgttgaggggactgggccactggaccaggtggtttcgaccctgcagaaggtcttcctgcccagcatgatccccaggaacaaaggctgagggaaggaactgagccaggctgggcaccagtcccacgtatatagcattttccatgcatgagtccagagactcctcaagagtcccctgtgagatagtgacctgcaaggtagctctgaaaagcaggcggctctggttggccaaggccactcaagggctgcttgaccccactccctggggaaccatggtgagcctgggggatcttagggtctccttctcttcaacaccagggctgcctcccaggctgccccaagaatggagcctgcatgtggaggtgacatgggcaccaccgctagatatctagacgcccacgacattcaaccatctctgtcttctcagtgaggacacaagaagggcagctggagctcttgcagaccccatgggagtgaggaagagggggccagtggggcacagcttaccccttagggagaggaggcctttcactttccagccagctatgaaaggcaaacagatccctacgacacgcactattcaagaggcaagtgatgcactccaagcagtgacatcccctgcagtgcagcttaaatgaagcccagagcacacgttacgatgcccatcaaggtagtattcgtcctaacctgctttcttcctacccaagtttacaaataggctctcagtgtgccactgaaagaagagaatcctgctcacaatgcagttctgatcatgagaaggaggaaaaaccaagtcctcaatgccacatccttgacacgtttatttcccaagaaggtacaaggagatggccaagggcaaaataagacacactcagacctgaaaagacttcacatgataggcagaggttctgttggcttcaggtggggcccatgggaagttaccctcaggatcctggggcaccagaactggcagggcctggggacagcctccccacctctcccccagctgcccgctgggaggcagggcttccctctgctgctctcccaagactcgctccctactgaggtccatggtaacagagacttttgcaagttctaggatcccatgaagggagagcagcagggccccagggctcagagtgagtggggaagtggcctgccaggggcacacagccagcagctggtccaatcatcatctccatctaaggggtgccttagatttgattcccttttctgtatctaataacaatttttattcacaaaactcctctggttccgccagccagcatagcccttccatcgccctttgaggaactggcaaggccaatgtcagctttccagtttcaggaggagctctcgctagaaggctgggaggggtaggctagggctgtcgggggcccaggagggccagggacaggggagtggggagtgactgcgcatgggtgtggggtttcatctagggtgatgcaaataccctggaattagggaaggccgatggtggcccgactccgtgaagataccaaaacccactgagctgtatactttaaaaggatgaattttatgatatgtgtgtcatagtttgatcaaaaagaaagaccaggaagaaaaaaccccaacatacatagaagtggaattttcgctaggcctgtgtgtggtggtgttgattttattttctctcggggtttggctgccgtctcagtaagggtaaaaacagaatctgagaaaacacgagggaaccaaccccatgaagctcctaccacgtgccggatgtgatgtgagcccttcccatggctgtctccttccaccgcacagccgccagccccacacacagccagcaatactgctgcatgttaaaggtgtggcaggcgattcctgtgctgaggcctcccagccaggagccacacaggtggaaatcaagcctaatattttcccacagtatcgtcacagtgggagcacttcccaggggtggtgtttttggagctgccactgggtggaagggcacccccagcataggaacagcatgtataaccacacagaggcatgatccacccaggctcattggggaacaacaactgtagtggaaacagaaggtcaggggatgccggagatgtgggagctgaggctggagccttgagcagaggtcaggtcatgggtggctttgctgcctttccatggctcttggacttggcttgaggacaacaggagcctttgaggggtctatgcactagctgagatggacactctctatttccttgaatctacaattcagtgtttttggaatcttagtcagtgggtatgtttcacattgcatgacttattcctgaaaggctgttatcaagtttatggcatagcctttgatccctggtctcttaaatacaaggacgtgtggactctttcttaaggggggtcgcatgggtgaccatggtcttctttctacctctggagaaaaggtggattctttaaacctcagggtgggcagcccccggattgggatgccaacatttctgaactggggaaggacaatggcagtggccactctgcacacatccctggggtgaacagcggaaaaggtgagggtcgggagtgtccagagtggagctcagataagagtttactccagagggactgagcttagccagcagaagagtctgaacctggctttttccagcaagtgttcagagatttcctggagatattagctggctgcagggagaggtgttatagttaggagagattattcccctcaccttctaccaagaaaagtgtgactgggtgtgtgggtagggtgtgtgttgaatgaagtgtttccacccatattatacatgtggcccacccaaataataaaaatagctaggatgacctgcgcacacgtcatctcaatgagtaagtgcctagcctgctcactcattcctgccgtggggccacaataaaggctctgctatgccctgtgctttatggaagaatttctgacaatgaacatgcacgtcttctctcccaatgacagtggtaaagatgtaatcgccatcagcaacccttactgagcaggggcttgcagccaggatcagggcaacctagtgagtggctatgggcacagctctcttgcaggctgtctggatttgaattctgcctctacccccactcactgtgctgtgggcaagttatcgaaatgcctatgcctcagtgttctcatctgtaaaatggggacagtgacaacacgtattcctagggaggatttctgttgggaggatttagtccatgaatggatgtcgggagtgctgagcacaggcctgcacacactgtaggtgttcaacaggaaagagtggcttttattactaagcacattggatagttcatctcttctcatcctcacaatagctcgcagacagagagcctgtgattatctccactatacagaaatattaactgcagcacagaggggttcaatagctcattgaggccacaactcggtcatagaggcatgactggccgccaaatctgggatcccagagtctgaattcaaatccaggaggcctgataagacatacctagtgaccagggaggagccatcagaccaccagactcaggggaagggccaggagagcttggtctgaacttctaccatctgacccaggcctaagaccctcagtggcccttgatggagctcctgggcacttggtcccaacacagagctgaggcctcagtgttttacattagatgggcatggcctgaaggcagagacctgctagcacacagtagtggttcaatacatgtctattgaaggagcaaatcagcgtgggaaagggctttcctacacactggtccctttcacaaacagcgcttgccattttcagacagtggcctctgagtgtctttttcaggtgctgttcaaaaaggaaggcatgttttaaaaaaccgcatattactcgcctgacacaagaccatgaggcgccaccaaacgacaacctcaaagatgagtctttgtggtgtcggtccagcctgctgggtttggtaaagccctagagcgtccatctaggagaacacaggcagagtctttgcacctgctatttcactcaggaggaaagaaaaggatagtcttgtcagccaaggtgatttttaactcccagtcaggtcaggcgaatgggctttgcaattatcttgttctattatcttgttctttaatctgcaggtttccatgttttaaatagacttccaggtcatatttcccccaagctatagactactttagtccataaataatatcatcctggactatgatgaatcagcaaaaaatgtttaagtagagttgaaatcattactcttaccccaagtcaagttcttataaaggatgttccaatatgctcatggcccccagacaagggagcacggtgagggggttgatgctggctgggccacttatgcctctgacagcaaaagggctccagaagtggccattgctccatgctgctggattggaaaggggaagagcaagccctaccttacacagctatttgggggattaaatgaaatgctcttctttatatttcttcatatttaggctcttattctaataatggcttacattgatcaagtgggctccacgtgcccagctccctgctaagtgtgttacaaatgtaaccttgtgttacataagaacagtccagaatgtcatctaaatacaaccttgatctttgtctccttattcctctaaaatttaatccctggggctttatttccctgccccattctaggggctcatgtcttttctgctgaaactgagcagagtcctatcctagaatcacaatttcaatttagacatcagaattgccagtataaaataataatcaaaatcaactgaattgaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttccgagggttctggagtgtcccaaccttgggaccacccactcgtccttgcagttgtcctagcctgcaggtttgcaggtgctctttctctgtctctgctgcaaggtgtacatctctttctgtctctctccattgcagctcaagggatccagggtcaaggctgctctgcatatttgtgaaaggtgcaccgagcactcagctccctgataagggggtgggctgaggctaaatccagcccactctgaccccaacctaggtggccatgaggttagtgtattaatattaatcatgttttatgtgttctgtattttatttcgctttcatattgtatgacctttctgatttcagagagaccgacctttcccgagcagttattaatagcagctccctagctattaataattcctagagctagtaaacaacctgcctgagagcaggcctttcgtatgcaaacccaccaatccaaagtctatactccaatcacttcctttatcaaactctcacactctgagccaacatttcccctcccacaggccactccagagccaggtatcagacaactagggaacagccctgtagcccagagcctggcaacatgatctcaagcctgcctcccctgctcactcattcctgccatggggccacaataaaggctctggtgcaggctgtcccctccctctttctgcctcctgactgacccagtgcttccctgcgtggtcctgcatggcgtggtatgtcccctcctctagggaactgtgagtaataaattcttctttcagataaggttgcctccatgtccatcacctcgccatacaggattcatacaaattctgggtacattttagaacagctggttgcccctcccactcaggcatgtatgttcttgctgtaggtggccacttatttctttctaaacaccacccccccaccccttaccttccatgacacactctccctggttctcctccagcttctcgggatacttatccaaggttttgaggcaagccctcctctcattcatctcacacacatcccccgggtagtgattcttgaacttggctgcccattggaatcacttggagagtttttacaaactactgatactcattccttactctcagagatttggggttaattggtctgggggtgcggcttaggtgctggggttgttcaagctctccaggtgactctaatgtagagctatttgacggccactgtcctagggcttcccccacacctgcgtcacctgcagtgaatggtggtgcatggcccagaactgacaagcttgacttatagctgctgggagcattactggctgtggaccacagctgggcctgtcctctggaattgcccttgaaggatgtttcctccaccaaggctacccagccctccccaagaacaaactgcatccaatggctgactgatgtgggggcataaagttctgttcccccacctccaaattatcccactctgatgggccatcccagctccagagctccctgtgggctcaactgagacctctgttgtgctgagggttgctcaccttttccctctgctgaatcctggtcccatctcttcccctgcaggcactgatctgagctcattctccaatcagcttcctgcccacatctccatctcagggtctcttttctggggaactcaacctaagacacatctatgggcccatgattccaaatcttcatgtccatccacacatctgacaaaaattatttacttggccaaacattagtcagcccattgaaacttctcctaggcccatctgtgtacttccctgtaaaatacagctttagcaaaggacgctcctaggccattttagcaagaacccctttctgcagcacatctatctactcatcctttaccttatagcattccctcccgtggatgacttctctatctggtaccaatttccattaaagcacttgttattctgcatagcaatgtgctttttatgggtgtgtttccctatagacggagctcctgaagggccacccattgccttgttcctttatttatctgcccagtgccaggtaaaaggcaggtgtttagtaaatgcctgtttactgaatgcatgttggggaggatgaatgacagcacagataagagatgctccagctagatacagaaatccctgaaacgacagacactcctgctcttaaaatactttttataaaaatgctaaaactgtcctatatgttgtcctattagagggctgatgttttatagtattataaataatattttcccacaaagtattattataatttctagtccatagaagagaaaatgtagacctgtaaaggtcaggtaactcatgccaaggcacatgagaaattagggggtctggcagaacaagagcctggctcttctgatccctgtacggggctctttccttgacattattcctcagatctgcagttcctggagcaaagcactgctgccttgccaccttcccttccctcatggtggcagctgctagctgaatagggaatttatatgcagattctatcaggctgaacctgtcacactcctctatggcaggtcctatacagaactcatcagtgatcactcaagctcaactccaatagctcatgctattacaaaaacatcaagatagtgaagcctgcactcacattccatagggttgctttgttacatctttgaatgcttcctgcttgtttagcagtggggcctcacagggaaatagtgacagccagcaaatgttcatggagcttctttgaccttaccgtccctcccaacaactgcctcctgggaaggaccctgctggccacagctttactgaatcctggggtggggagcatgtggctggtcgtgtttgccttaccaaccttacctgttgggcatgagggtcaatgtcaccctctccacacctgaccccacagagtacaagccagctagtaagatggctcaattcattgcagcaaatatgttgttctagaattgctatttttggtgcgcattcatgctctgattctatttcaacactaacaataacaggtatctcaagaacatgggcttttgtgattacctctcatttttctctgttggaaataataatgagatgaacttccaaggctacaacactcaccacacaaaaagtggttttgagaattggatgtgagagaagcacccacatagagcccccccatgggtcatctttcaagaaatgctccttcccctattcctaaaacattttctatttttcaaagggtttggatgtcctctgccttgcttggttctcaagcaatcttatgggaaaaaatgctcaatatcactaatcatcagagaaatggaaatcaaaaccgcaatgagatatcatctcacccctgtcaaaatggctattattaaatgacagatgctggcaaggatgcagagaaaaaggaaaacttaaacactgttcatgggaacgtaaactagtatagctgtgaaagaaaacagtatggagagatcgagaccatcctggctaacacggtgaaaccctgtctctactaaaaatacaaaaaattagccgggcgtggtagcgggcgcctgtagtctcagctactcgggaggctgaggcaggagaatggcgtgaacccgggaggcggagcttgcagtgagccgagatcgcgccactgcacgccagcctgggcgacagagcgagactccgtctcaaaaaaaaaaaaaaaaaaaaaaaaaaagaaaacagtatggagatttctcaaaaaactaaaaatacaattaccattcaatccagcaatctcacctctgggtactactcaaaggaaaagaaattcatacgtcaaagggatacctgtactcacatgtttattgcagtactattcacaatagtaaagatatggaatcaacctaagtgtccatcaatggatgaataaagaaactttggtatatatacatcatggaatactatttagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaaggaataaatccaatgtttgatagcagggtaggataactaaagttaacaaaaatgtattttattcaggtgatggataccttaaatattctgactcaatcaccacacaaatatgtgtaacaaaatttcacacataccccataaatttgtacagataataaagaattataattgccatatcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcagaaaaggacaggaaatttacaaaagattcatttaatgtttggatgaatggttgcagaattagagtaggtatcaaagcagtggggttaagctgactgcctggaaggcagaggctaaagcactgtggcttccatgtgccacggctcagctcataagactcccaatgccacagaagccaagaaagagagtgccctctggagttggcccacctctgaggttgggtcctgaaccctggtcctgccacttactgattgtgagataacagataaaccacttcacccctctactcctcagtttgctcatccgtaaagtttagtccacagaggaggacctcacatgcagtaggggctttataagtgcttgacataattcgaatatatgtccctgccaaatatcatgttgaattataatcgccgatgttggaggtggggcttggtggaaggtgtttgggttatggggttggatccctcatggcttagtgctgtcctcatgatggtgaatgagttctcccaagatttggttgtttaaaatttgtggcaccttccctagccttacttctgcttttgccaggtgatgtgcctgctcctggagccctccccagaagctgagcaggtgccagtgccatgcatgtacagtctgcagaaccatgagccaattaaacctcttttctttataaattaccctgtctcagatctgtctgtcttttttttttttttaaagacaggatctcattcagtctcccaggctgtagtgcagtgacgcaatctcagctcactgcatccccaacctcctaggctcctcccaccttagcctcccggtagctaggactacaggcatgcaccaccaaggccagctaatttctgtattttttgtagagatgggatttcaccatgttgcccaggctggtctcaaacccctgggttcaagcgatctgcctgccacagcttcccagaatgctgggattaccggcgtgagtcaggtgtttacagccgtgcaagaatggccaaatacaatgtttgataaataatagaaataacaatgtcagagctgttttggaagagatttctgcattccagaagcggtcgggtcattttctgctatggtcaatttctattcacagattctgtgatctgaatgtcctataactctaacaagctgtaattcttgcattgtaagatgctttgcaaaagtcctagaatcatacacttgtgattttaatgttctatatccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcattgggcagtgacgagaggtcccacactgtatcatctgcctgtctcaaatctcagccacatgctgttgcttaaagagctggagccactgagggccaggtgggcccagatgtgggcactggtgccttgcccatctgagtttgagtcctctcctcactgcactgcctgctcccttggtcattttggacctcaaatttaaatttaacctctatgagcctcactttccttatcaataaaatagagataataaaacctgcattactggttgtgctggggattcaacagattacatgcaaagtgctcagcctaatgcccagtttaggagttttttgtttgttggttgttttttgagacagggtctcactctgttacccaggctggagtacaggggtgcaatcatggctcactgcagccttgacttcccaggctcaggtggttctcccacctcagcttcctgagcagctaagatggcaggcatgcactaccgtgcccagctaaattttgtttgtttgtttgtttgtttgcttgtttgtttgagatggagttttgcttttgttgcccaggatggagtgcaacggcaacatcttggctcactacaacctccacctcctgggctcaagcaattctcctgcctcagcctcccgagtagctgggattacaggcatgagccaccatgcccggctgattttgtatttttggtagagacagggtttctccttgttggtcaggctggtctctgactcccgacctcaggtgatccacccacctcagcctcccaaagtgctgggattacaggcttgagccactgcgcccagccctaattttttgtagagatgaggttttgccatgttgcccaggccggtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattccccaccaggaatgtcaggtggccatcaggtgatggtcaggcagttgttaaactgtctctctaaaataatagttggtcacagctggcaattattgggaaaggcagtcagtctcccaatagaaaaaaacctaaaactggtgatcataagcttcccgacaagatctcaggagttgggcgagtgggctcaagcatatgcacgaagaggcaaaatggcagagtttacctggtatatggccttcctctgggaacttttgactggtgagggaaaaacgcctcaagtcagcatgtgcacaacgtcagtaaacacacggcgtgtgcggcccctcctaagtgctggcaggccactgtgcatgcaaacagcccaatccaaggggaagaatcagggagaggagacgcaaccccctggaagcataacatataaaactccaagtcggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactggggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaactccaagtcaaagttcaaaccgtgcacttgatctctcaagtcgctcccttggtgctctccaagtgtactttacttcctttcattcctgctgtaacgctttttaataagctttcactcctgctctaactcttgcctcagtctctccctctgccttatgcccctcgtcaaattttttcttctgaggaggcaagaattgaggttgctgcagacctgtatggatttgctgccgcggacacctctgtctctcaaagattccagatttgggtcagtattaaccttttgagccccactggacattctctagggattcttattcagaaagtctgaggtagggctcaagcatctggatttttttttttttttttttttttttttgagatggagtttcactcttgttgcccaggctggagtgtagtggtgcaaacttggctcactgcaacctctgcctcccatgttcaagcgattctcctgctccagcctcccgagtagctgggattacaggcacccaccaccatgcccggctaatttttcgtatttttagtacagatggggtttcaccatgttggccaagcttgtctcaaactcctgacctcaggtgatcgacctgcctcggcctcccaaaatgctggaattacaggcgtgatccacccagtgagcatctggatttttaaaaagtatcatcggccgggtgcagtggctcacgcctgtaatcccagcactttgggaggccaaggcaggtggatcacaaagtcaggagatcgagaccatcctggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggacaacagagcaagactccatctcaaaaaacaaaaaaacaaaaaaacaaaaaaaagtatcttcggccattctgatacacagccacctccacctatgagcctcttctctggaggaattgagagctttgttaccagcggcgttcacatagaggctgggtgctatttgagtctcagtctcccatttataatatgaatgtctcaggctttccttaaagggttttctagggctagcatttcaaattgtgatcgttctaaaatttattcatttgaagtttcctgggtgccttttgtgtattgggtaccgaaaaatttttttaaaacttcttgataaacaaggcagattgtccatgccgatttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcactcggagcctctgtgggggcactgaagggaagtgaagacatttgccccaaagacccctggtggctcagcatggaggacccagcaaagacagggtgagggtgggaatgaaaacagagttttggtggcaggcctttagcctcatgccctttattcacttcttgatgggaaccagaagatggggttcattctcacaatcaatggaaccacagtcattccaggcttggacataccagatacagcagcaaaacaggaggccaaaaacatgaaaataaatctcagagccctcagtaatcagcagtgaatcttttcccagaataggcatctcccattctttggaggagaatccaaacctccaaagagaaaaggcattcacacactgacttgtggggcctcccaatacaaatcctgctcacgctgtcatcactcttgagtgaagccttgtccctcacccacagcttttgctcaccttctttttaaatatgaatgggagaaccacacttttgaaaaagtgtctaacacaaaggagaaaggcaaaaagaaaccaacagaaagataaagcaatctggagcaaagagacaaaaatgtagcagcagaacaaatgcagggggcaatacaccctatcagtaataccctctaaaatatagttgtaaatattatatctaaaaaacaagaacaggactccatgtaaaatgaacggggacagggggaaagcccttagaaattaaaaatatgataaaataataaaaatacagtggacaagttggaagatggatttgagaaaatgttccataaagaacaaaatgataaagagatgaaggaaaggacagaaaatactaaaatcaaacttagaagagcagcctattatctgactgcaaggagtttcagagaaaggagcaagaatagaaaaatgggaggttaggagaaaattatcaaagaagtaacataatgatctagaatgaaaggaaatgagtattgagaattctgcacaactgaagagaaagattctcacctatggaagtaatcatacaatttcaaaactagggataaataagaagattctaaaagttaacacagaaacaacagttcacatataagtgatcaaaaataagaaaggcatcagatttctcatcagcaatgtcagatgctacaggacactgaagcaatgccttcaaaattctgaggaaaattatattcatacaagagttctatatctagcctaactatctactgggtataagtatagaataaagacatttttagacatggaaagtctcaaaagctttgtcttcattgcatgttttcttcttaagaaagtactgcaggaaatgatttagcaaaacaagaaaataaaccaagaaaaaaaggatgagttcatgtactttgcagggacatggatgaatctggaaactatcatcctcagcaaactaacaaaggaacagaaaaccaaacaccgcatgtcctcaactcataagtgggagttgaacaatgagaacacatggacacagggaggggaacatcacacaatggggcctgttggaggtgaggcctaagggagaaataacattaggagaaatacctaatgtagatcacgggttgataggtgcaacaaaccactatggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatcagcttggccaatctctttagtgagatttaggccaatctctactaaaaaaaaaaaaaaaaatacaaaaattagccaggcgtggtggcgggggcatgtaatcccagctactctgatggctaaggcaggagaatcacctgaacctgggaggcagaggttgcagtgagctgagattgtgccactgcactgcactctagcctcggagatacacgaaactctgtctcaaaaaaaaaaaaaaagaatactgaggcctcaatcatcagattgatgtctcaatcttagacatcaatggataatatctaaagaaaatgaatttaaaagttctatcatcaattattttaaaatatggtggaattatcaaataacaggtaaaagagttgtaagagattgcctctggagagcagacagggagcttgagggggtgggacgatggacctctgtgtgtcactataagccttttagcagtattgaattttttcaatcatttgcttgcattgttttgactaaaataatttaaaatttaagacaaagattagttgaaatatgaatacttttcctttggggttccctttgtggagtttcaagtgcccctttgagatttgtttttggtagtgaatccctggtctacactctcaggctccatttgctgtgactgagctgcacaaccagactgtatcctgggcctaagaaacgtggatgttctggctttcggggaggggctgagtcacattcagggtccgacttgactgctagatgaatttggtggtaggcagggagataatttatttccaagcattgtcccacttcaacaccacgcccttctgggcaggaaccagggctaactgggttatattctcccccagtgtttaaagcatggaaaggaatcattatcagtgggcattacttggaaaagccgcaagtcaagaagttatacaggagaggagccttattgttccaaatattagaatttgaaatctgccagaagcaacatctgtctcatccagttattgaagtgcagcatttgaatttacatctctccagggccttgagcctacccaagtcactcaggctccgctaaaactgcacagactggcactaaagatgcaaaataggcctttctgcctggaaaataagttccccttcaccagccccaggtatcaccctctatacaagtaagttaatacaaaatgctgcctaactctccccatcaaatacctaagttggtggacaatattaatgatgcctactctatgctgggcagtgccagggaagaaaggggaatatgaacaggagtggcccagccccttaagggtttacagtgaaggtgaagtcagagggaagcaagaagacacagctcctccccatgtacccctatctgatcaaaggcacccacagcatgtgaaaattcaacagaggaagagaaagcttttgtcaggagccaaagctcacgtggcattcagcatctcttctcatttccattttcagaagggctgtgaaaatgctatttcttttttgttgttgttgtttgaattaggcttttcttgaaggctgagtgacatggattgagaggggtgatgagagaggtgattccaggcccagggagtggcatgaggattatgggatgatagtcagcagaagggaaatgggggcagttgaatggcactagaggatagaatgggttaaaattggagactgaacccaaattcgggagccttcaaggctagactgagggattagggcttcatttggtggacacaggatctgttgtttgactggatggctcccatttgcagaaacggtacaaagtcctttacatatagtgtctcttttaatcattgcattaactccatggagtatgtattaatattattgtcctcattttacagaatcagaaactaagcctcagagaagtgaagtaacttgttcaagtcatacagctagaaagcagcagaggtagaattcaaacctttaacttcctaactcccaagtcagagcaatttccgtcatgctatgccccttcccacagagaggcttggagtgacccagccaaagcacagtgctagaaagatgtttgggcagcatatagccaagacaatcctaagcaaaaataacaaagctggaggctggcttcaaactatactacaaggctacagtaaccaaaacagcatggtactgatacaaaaacagacatatagaccaatgaacagaatagagaactcagaaataagactgaacacctacaaccatctgatcttcaacaaacctgacaaaagcaatggggaaaggattctgtatttaataaattgtgctgggagaactggttagccatagacagaaaatggaaactggaccccttccttacaccttatacaaaaattaactcaagatggattaaatgtaaaacccaaacctaaatgtaaaacccaaaactataaaaaccctagaagaaaatctagggaataccattcaggacataggcatgggcaaagatttcatgacaaaaacatcaaaagcaaaaattgacaaatggaatctaactaaactaaagagcttctgcgcagaaacaaaaccaaacaaaaaactatcatcagagaaaacagacagcctacagaatggaagaaaatttttacaatctatccatctgacagaggtctaatatccagagtctagaaggaacttaaacaaatttataaaaatcaaacaaacaaacaacatcattaaaaagtgggcaaaggacatgaacagacacttctcgaaagaagacattcatgtggtcaagaaacatatgaaaaaaagctcaacatcactgatcattagagaaatgcaaatcaaaaccacagtgagataccaatctcatgccagtcagaatggagattattaaaaagtcaagaaacaacagatgctgatggggctgtggagagatacgaatgcttttacactgttagtgggagtgtaaattagttgaaccattgtggaagacagtgtggcaattcctcaaagacctagaaccagaaataccatttgacccagcaatcccattactgggtatatacccaaatgaatataaatcattctattataaagatgcatgcatgtgtaagttcattacaacactattcacaatagcaaagacatggaattaaccgaaatgcctgtcagtgataaactggataaagaaaatgtggtacatatatactatggaatactatgcagccataaaaaagaacaaaatcatatcctttgcagggacatggatggagctggaagccattatcctcagcaaactaacacagaaacagaaaaccaaacactgcatgttctcacttataagtgggagctgaagaatgagaacacacggacacagtgaggggaacaacacacactggggcctatcgggggacctgggcagggggagggacagtaaacaacctaatgcatgctgggcttactacttatgcaatgggtcaataggtgcagcaaaccaccatgacacatgtttacccgtgtaacaaacctgcacaccctgcgcatataccccagaacttaaaataaaacttaaaaaaggaagatgtttgggcaggtgtgactgaaactgcagatgtgtgcagaggcagggagtggatgagtgtggccccagctgaccatccacctcatcacttgttgtcacctctggcactcttattaaatcactctcagtttctaaatgtgcagagctccctcttgttctttttttgtttttgcactggctattccctgtgcctggaatggtgttttccttcccttcatttggctaattgtcctccagaccccaaggtggatgccaccttctccagaaagctttccgtggccctctctcgctgcattagggccattaggaaagaggtctaacagacttccacagtttaacatggctgggaagatctcacaatcatggccaaaggcaaagaaggagcaaagtcacatgttgcaatggtggcaggcaagagagagcatgtacaggggagctcccatttctaaaaccatcagatctcatgaggcttattcactaccatgagaacagtataggggaaagcaccaccatgatccaattatctccaactggccctgcccttgacacgtggggattattacaatgcaaggtgagatttgggtagggataaagccaagccatttcaggaccattaaaaaattcactaatcagggtcttcttcataattccaaggtcaagggaaatgtgtaccttccctccacattgagggggtagctcaatgctacagaccccacggtcagctctacgttgatacaaagatgagaacttggactttggtcccagggaaaggtggacacgcggatgaccacctgaccactatgtagaacaaagcaagtctgtgagagaggagtactgtttgtgggaggcagagatggggacagctgattctagtggctggcaggagagagggcctctcaagaggcccctgctcgctgggttttgcaggatgacaacagtcagggaatgtagaaaaaggaggttgggaggaagaaacagcaaaggcagaggctgggaggtgggacccgcattgtgggatcctggaatgggatgtggagtcacagtgggatcctctaccttttgtgtgtgcaagaatcacatccagcgagtctgataaacaatgaagattcttggggaaccacctgcttcaagattcagatcttgaggtctggaatggggctgagaagtctcatttaacaaacacccaacacgcttgttaattccaatgtgctgtctattgggcttagctgctctgtgaggtggaggggtggatgggtggagataaagagcctggagccaggtcatacggacctggcacgtcaccatcctgggaggtctaaaccctgcagagggaaatcagggagtcaacactgaatatcgagggggagacattcgagaattcttacaaaagagttgctgaatgtttattaaagccaattttgtatgcacccgggtatacaaaagagtctgaaattatacatgtcgtgtaggtttcagaatcttggttcaacagggattggccagggcagggatgagaatttgcatttctaacaagtgccttcccagctggtgccagttctgctggtcctgggaacacgttttgagaactctggttgttatttaaaggagttcaggcattaacctgtgagggactctgaagtggcaggaagaatgcaaaggtgacaacctctaaacttcttttctcctatttcccttcaaaggaaattcatcatgcaatggccttcaacccatctgaacattttctctggctacagaaaatgcctgggtcgtgccccgaaatgaatcttcttttcaaagagaaacggtaggatttacaggtcagtggaggataaggacgatgttgctgggtggctggggcttaaaatcactttaaaatagatgagtacatttcttctaatattcttgataaaaatcaaaagttcttctcttcctggacttgaatgaagtccagagagttctaagtcaaaaagttcacagaaaacaagtgctttcaaacacttagggtctggatgagaaaaatatgaggctgcaaaggactgttttgctcaaattcctataccagactctaacctttggggacagccctcttgcctctccatcaacaagtcaggacgttggtcctaccacagagaaattatgggctgcaaaaccaggaagctcaagtcccactgcctccctgctgcagacattcggagtaattatcaccccgctctgagactgagcttttcatctgtaaaatagaaatttcataacatcttttctaagtactgccacatgacataaatgacgcgatgactgacatcaatttggcaccagttccaggcactgttccaagtgctgaacatgtattctctttcttaagccttacaaaatccccacgaaagaggtcccattattaatgctattgtataggtaacaaattaggcttggagaggttagcaacttgcccaaagtcccacagcaagtgtgtgtgtgagaggtgtggggagctgtgatgcagatccaggcagtcgggcacgagggcccaggtgcccactacacagccctgcagaggctgttttgggcctttccctttgaagctcatttctctctgatagaatcacacattatcacccttttttaatctcatgggaaatttttctgtattttacggattaaccataattattgtgatataataaaaatcacttgtaattttggatctgttttttaccattataaaatggtaagtgctaagaaagagctgccatccttaagcaaacatggaatattaacaaaagatgatcacaaactgaccacagaataaactatcatatgttccccaaagaagaaacttatggatgacctttctttatgtaataaaacaaaactggtaatgaatgaggataacaaaatcccatctacaaaatcccaaaatcccaattgaaaacattgttctaaataattaatctgtattcatttgtgtgttgtttatggtatctgtttttacatttgattcttaaaatcatttcagttattttttaaatggtgtaaatttatatagttgtatgctaacaaatttgaaagtttcgatgacataagtgactttattgaaaagacagaaattaatgacatcaactcaaaagaaaataaaaatagatttttacgaaagtagttaaaagatattcaaagcatttttttccccaaaagactacagggtgagatggttttactagtgaggtcttttaatactttgattatcaactaacgaaatgtgagaaattacatttctgtctctgctgtggttacttgttacagcatcaacaggaaacaaatatacttataagaaattctcatctattatttttgcctatcaaataccaaagcctcatttaaatgcttgtggatgacatgggcagagtgagactaatgcccttgtgccctgccagcgggaatggaaattgaagcagactatccgaaaaaaaattgctcatatgtacgaaagccttaaaaaaatttacactctttaacctgttatttctatttctgaaacactaaactacatgaataattacagatttgaataatgattaatgtagaagattattcatctgaagtttacaaatcacactttttcagtaataaacacactggaggctgggtgaagtggctcacatctgtaatcccagcactctgatgggccaaggtgggtggatcacctgaggtcaggagttcgagaccagcctggccaacatggtgaaactccatctctaccaaaaatacaaaaattagccaggtgtggtggtggatgcctgtagtcccagctactcgagcggctgaggcaggagaattgctagaacctgggaggcgggggttgagagccaaggtcgagccctgcactccagccttggcgatggagtaagactgtgtcgctaaataaacaaacaaacactggaaacaatccaaatgtccaggaaataaaagaaaaatgaaacaaattataactcataaatagaaactagtacaattattaaaacatggtgtaatgtaagcattgctttagtcttttttcctacccttttcccattttttcctaagctattcattaaaccaaacatttcctctgttgatttttgaggtttccttttgcacacattaaaatcatacatagaaatgaattttctgcttctggccatcccttagtgcctttgatctttccattcttgtgcccatgctgcattgttttaattgttgtcactttattacatgtttaatgtactcactagcgtccattttcaaaactatgtcagaaacatacacttgcttattctcttgtgggaactttagaactctttcctcattttccatcacaaacagaaatgtcattgaacttttgattgaaattgtattgaatgaatacattagtttgaatacaattgagattgttttttaaaattcattattatcattataaaattagtaaaactatcacagcaaataattttaatgacttgttcacaacatcaggttgcaaaataatcagaatacaaaaagttataaatggaatgaaccaaattatgtgcttcttaaattttataaaagactaaatatcattgggcctcttaatacacactaaaattatgttatgttgaaacatgtttataaaactaaaaaaggatttcatctataaaatatttgtatgtgatagtttaaaatttctttctagattttcactaaaaattaagattaataagagttgagcattctgatttctgcatataattctttatgtaaaatgtaccaaaaaagtaagaactgtttttaattaaaaaattataagacaaaatatgtacttcatttaaaaataatttttttaaattaaaaggttattaaaagttgtgtcaaaatatggatttagaaagaaaatataaacaaaaagaatccagtaaatagaaagagatataaagaaagttatgggaataaagatatatttctggtaagaaagatttaagaaaagaaaataactttacattaaaaaatcttgcctggtaaatgttttttcctaaaataaagtgactggttatttaaaaataagaaagtatagaacaaaacaaaagttataagcatgccatgaaagttacgaaagtctgtgtaagttgtaaaaggtctgaaaatgataaatttacaaaagaaattttgtatgtgatcaagttgactatatttaaaagggaattatttataagcctttctaaggtttgagttttgatattaaaaatacaccaatacaaaactaaaaatttggtcccttatgttaaagcaacaaagttttcttgaagtaatgatctgcttttagtaaaatttacaagaagttctgatttttaattgtaaaaattttcagccactttctaaactgtagcttatttttttgtttgttttatagtctccatttaatttaactagtttttagtttaaaatgctatcttcttcttaaaaatggtatcttcatttctcaaggtggagttttcgtcttgaagcttctcagagtcctatctcagaagttcaattttaatgtgtctcacagcatagcatgtgcagttcatactacattgccttctgttctttcactttctttccttgagaaggtacatctttttgcttggctggaatgttgactttctccttcaacttctttgttagctcctataacttcttcctctcattctaacagctattgaggcctgacactaaaaatgtttgtctcaaagacctagaaaagcaatgtttctttttttccagtataacttgattctgtacttagcttttcttcatgtgtctacattgttccatgtaaccagggaatttctcatgcttttactaagagccatatatccccctgcttaaagtaatacttttcttgtttatgttccacagtgtacagtcatagccttggatatacattctgaatacatacaagtactttttcatcaggttgtctaaacaggcttcccatgaggtgaaccaatcacatagaaggaggtttttcattgcctttttagtaactggcctaagaaacaaatattttatattttatcaagataatttcctgtgttgcctttactaaatttttttattacttttaaaaaatggagactttaagggttaaagtttttttaatatctatataactttctgtattgcttttaagatctataattatcactctaattaaataaatgactatcacacagtgccctgtgatactgttttgatcaggtattttaaaacttttggcatctttgatggacttccccagcatcaaaatgctaaattaaatctttttgacataaacttaactttgagattttccagtcaggcccctagaaagcctcaaaggacttctctctcatcttgtagagatattaaataattaggcttatttggtaaattatatgggaaatatcaaatgctaagtgatactagatcttctttcagttacatttatggatatgttattggtatatatgttctaaaatggtaataaaactcttaaaatcttctatgttatcagtcataattttggttattatattgtaggccacaaaataactaaatttccttgcaaatttctggttatggggaacttttatcctattttcaactatggtagttttaaatttttgtcatttacagttattttaaatttttctctaaagttatctgcaattagattcattacaaagactttgacaaatactcttaaatacaagtttcaaaaaactttaagatcaatgtggtttttttcccccaagatggcagattagaggcattgttagcatgcctcttgtattagtcccttttgatgctgctgataaagacatacctgagactgggtaatttataaagaaaaagaggtttaatagactcacagttccccatggctggggaggcttcacaatcatggcagaagatgaaggcatgtcttacatggcggcaggcaagagacagcatgtgcaggggaactctcctttgtaaaaccatcagatctcataagacttattcactatcatgagaacagtatgggaaaaatccacccccatgattcaattatttgccactgggttcttcccacaacacatgggaattatgggagctacaattcaagatgagatctgggtggagatgaagccaaaccatatcacctctcatacttggaaagacaaaatagtgtgtagagactcacgctataattttttttccaagaaacaccacaggcatttaaccagaaaactgaaagaaaccacagactctttgaaagaagtggtggcagcagcctacaccataagccaggtggaaaactgtgagtcctcagagtgtggcagtgggagagactgcctctgtgacacacactcccgctagggaacctgataatataggccatgggggatggccttggccccacccagcactggagctgagtggtggggaatgttgagaaggagcagcatcggacatgctttgcgtgcactcctagactccagtggggatggagagaagacattcctgactctacttcacagggagccttgcagaagtcagccagccaactcgggtggcagtcacaggttgagagaaggtctcaactgtgattcacgacataatcttgagtggggatgagctcccttggccagaactaaggggcaagtgggggtactgtagtcacaagtacagaagctgggcatccctgctttggggtggaccaggaggggcacagcctgaaaaccacagtttctgtctgggtggggaaagcttatagcctgtggcagttttgagttctcagtgcaaggttcctggaacccagctagctgggttaaacaaacaaaaagagtttgtgctgttgctaatactacatgctatacttggataaattcccctagaagagttaagactcaaagacacaaaattaaaaaaaaaaatgcaggttacaatgagggaagaaagagacctctcatattgttttatactcagtacctgttttaagaaaaaaacaaggaagtgaaaccaaaggcaggcagcccagcgccaggcgccagacccaaaaccggacccaaaaccaggcctgggcctgcctggcctaaacctagtagttaaaattccacccctgacctagcaactgatgttatctatagattccagacattatatagaaggacattgtgaaacctcccattctgttctgtttcactctgaccaccggtacatgcagcccccgtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcattgtgtgagaggttttgtctgtggctcatcctgctacaacaacaagtttcacctaatttgtcatgatcatttaattaatttaatttatttaatttatttaattggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaacttaaacttaacacttgattttaggtagatgtagcctgagaaccactctctccaaacccctcttgttgctcaaatgtagctaaaagagtttagacactaactccaattacaccttccaatgtaggaccaaccaacaacgtgagacaggttgatcccagctgcctcacctagggataatcaaaacctaactacaaaatggttaaccagtgatttttttaaaaaatcttgatcaaaaaaggaaatgtgaaagttgtcagaataaaaataaagtcacctgtgttaaaaagcaaaaataaaagcaaacccctgaaaaataaagctaaggaaggtcatgaaaggaagattctcatatacagatgcctgctggcaaaaactattgcaaaagactgcaaaaaccttgcacaaaggccactacaaccttacacgagaaaatactgctgcgagaacacctgcctagcaactgcctgtccaaccttggactgatgccacccttgttactgatccttctattcaaagataactatctcaaaaacaattacataattcgtctcattttttctttaaaatcctttgtcttctttcacctccctgaatatgcacatggtttactatggcacacctatgccaattgcaatgcccattcctgaataaacattgttttctttcagaaagtctccctgtttgttatttagattgaaaaaatttgcaaccattagtatatttctttccttgagaggaaagaaaagtgggagctcaaagttaatcattcttatctgacataaatgttcttctgagcatataaaatcgttcctttacggcctcacatcattcctaatctctcttctcatacttttgcctataattttcatctaagtctatttcttctttatctttgcaagagaaatagctaattgatttgttttaaaaaaaatatatcatttggagtcacataaatgttcagccatgacaattgttttatgatgtatctttgattaaattcatggaaccagcattaattcctacatttatttccctttcttgccttctagcagcctactctaaaagccaccttcgtctaccacaggctcagccataaagcaagtctcagtagattcaaaagaattaaactcataccaaccatactctcagaccacagtggactaaaattagaaatcaacaccaagaagatctctcaaaaccacacaattacatggaaattaaatgacctgctcctgaatgacttttgggtaaacaatgaaattaaggcagagatcacaaattatttgaaataagtgaaaacagagacataacataccaaaatctctgagatgcagcaaaagcagtggtaagaagaatgtttagagtgctaaatgcctacctcaaaaagttagaaagatctcatattaataatcttatcaccactcctagaggaagtagaaaaacaagatcaaaccaactccaaagttagcaaaagaaaagaaacagctataaaatcagaacagaacagaacaaaattgagatccaaaatccatacaaagaatcaatgaaaccaaaagttcattatttgaaaggataaatgagattaatagaccactagctagattaaaaaagaaagagagacgatccaaataagcacaatcagaaatgatgaaggtgacattataactgattccacagaaatataaaatatcttcagagactattatgaacacttctaggcacacaaactagaaaatctagaggaaatgaataagttcctggaaactcacaatttcccaagattcaattaggaagaaactgaaaccctgaacagaacaatatcaagatctgaaattgaaggagtaataaaaaacctaccaaccaataaaagccctgaaaagatggattcacagccaaattctattagatgtacaaagaagagctggtaccaatcctgctgaaactattccaaaaaattgaggagggactcctctctaatttgttctttgaaatcagcataacaccaataccaaaacctggcaaagatacaataaaaagaaaatgtggcacatatacaccatggaatactatgcagccatgaaaaatgaagagttcatgtcctttgtagggacatggatgaagctggaagccatcattctcagcaaactatcgcaaggacaaaaaaccaaacaccgcatgttctcactcataggtgggaattgaacaatgagaacacatggacacaggaaggggaacatcacacactggggcctgttgtggggtggggggaggggggagggatagcattaggaggtatacttaatgttaaatgacaagttaatgggtgcaacacaccaatatggcacatgtatacatatgtaactaacctgcacgttgtgcacatgtaccctaaaacttaaagtattaaaaaaaaaaaaaacagaaaactagaaaccaatatccctgatgaacatagatgaaaaaatcctttacaaattaccagcaaaccgaatccagtagtatatcaaaagtcaattcaccatgatcaagtaggcttccttcctgggatgcaaggttagtttaacatatgcaaatcaatataggtgattcaccacaatagatgcagaaaaatgttttgataaaatccaacaagccttaatgataaaacctctcaagaaactaagcattaaacaatcatacctcaaaataatgagagccaactatgacaaacccacagccaacatcatactgaacaggcaaaagctgaaagcattcctcttgagaactgaaacaagacaaggtgcccactctcaccactcctattcagcatagcaataaagttctagccagagcaatcaggcaagagaaagaaataaaaggtattcaaataggaaaagaagtcaaactatctctcttcactgatgatctagaaaagactccaccaaaagtctcctggaactgacaggggatttcaggaaagtttcaggatacaaaatcagtgtacaaaaatcagtagtatttctatacaccaataatgttcaagctgagagccaaagcaagaatgcaatcccatttataatagctgccaaaaaaaaaaactaggaaataattaaccaaggaggtgaaagatttaaataaagaaaactacaaaacattactgaaagaaatcacagatgacacaaatggaaaaacattctatgttcatggattagaacaatcaatatcattaaaatagcaatactgcccaaagcaatctacagattcaacactatttctatcaagctaccaatgtcattttccaccaaactagaaaaaaaaattctaaaattcatataaaaccaaaaaagagcccaaatagcccaagccatcctaagcaaaaagaacaaaagccagaggcatcatattacctgacctcaagccatactgtaaacctacagtaaccaaaacagtatggtactggtacaaaaacagacacatagacaaatgaaacagaatggagaacacagaagtaaagctgtacacctacagccatctgatctttgacaaagttgacagaaataagcaatggggaaaggacttcctattcaataaatggtgctgggatagttggtttgccatatgcagaagaatgtaactggacccctacattttaccatatacaaaaattaactcaagatggattaaagatttaaatgaaagacctcaaactataagaatcctacgagaaaacctaggaaatatcattctggacattggccttgggaaagaaaattgcaaaagaaattgtaacaaaaacaaaaattgacaagtggaatctaattaaactgaagagcttctgtagagctcttcaattcaagcaactatcaatggagtaaacagacaacctatggaatgggacaaaataattgtaaactatcatctgacaaagggctaaaatccataatctataaggaacttaaacaattgaacaagcaaaaaacaaataaccccattaaaaaatgggaaaaggacatgaacagacacttctcaaaagaagacatacaagtggccaacaaacatattaaaaaatgctcaacatcactaatcatcagagagacgccaatccaaaccacaatgagataccatctcacaccagtcagaagggctgtgattaaaaagtcagaaaacaacagatgctaatgaggctgcagagaaaagggaacacttatgcactgttggtgggaatgtaaattagttcagccactatggaaagcagtatggaaatttctcaaagaacttagaactaccatttgacccagcaatcccattattgggtatatatccaaagaaaataaattattctaccaaaaagagtgatgcactcatatgttcatggcaccactattcacaatagcaaagacatgaaattaacttaagtgtccatcaatggtggactggataaagaaaatgtgatacacatacaccgtagaatactatgcagccatgagaagaagcaaaatcatgttgttcgcagcaacatagatggagctggaggccattatcctaagtgaaataacacaggaacagaaaaccaaacactgcatgttctcacttataagtgggaattaaacaatgggttctcatggacataaagatggcaacactagacactggagacagtgggatagatggaggggagggatagaggggagaaaagttgaaaaactattgggtagtatgttcagtacttgtgtgatgggataaattataccccaaacttgagtatctctcaatatacccaggaaataagtacgcacacgtaccctcttaatttaaaataaaagttgaagtcataaaataaataaatagctaccttcttgctaaccctccttcaccctctgtgtttcaaagcaattgccttcattgaagcccagtttttctctctcttttttcaaagcttcgttgtctcagtctttgaaggtaaatgggaaatatgattaaaatagtgaaaatgaaattctgacacttagtgaaataactgtgaatttcacttggctggaacactgcaaatccccagagacatgaataaaaatttcccatttgatgttctttcctggaccagaagccctagatccacattcccagagcatacatttgaaaacagaaggatatttacagggttcctcacccatcttcctggccagggccaagactgtctggaaactcccatctgatgggaagagacagcctataggaaccaatggtacaccttttggctagctcaaagccagaaggtgggcatgggcagctgtgccccttggctggcatcatgttcatgagccctgttcctgggagagagtgtcccagcctcagaatctaggtacccaggtcctcgaatcagctcttccttccagttgctctgagacatgcacagttcacatcagtgaacttgtcaccttttcccctgcagagctactccttctctttcatagctccctgtcttagcatctggtaccaccattctatctggctgatgtgccagacgcctgagagttatttttgactcctcctctctgggacaccacatcccatcaccactaacctcactcaacctcatctgcctctctccatccacactgccattactctgacccaactcataactggaccagtcaaccccttcagtcctggctgggatccaatcctttctccatgctgcaggccaaaagccttcttgaagcactcatcatgtcctcaatgatgtcccattgctttggggtacaaataagccttcacagttacacagtccccatcaaggtgtgtgaaaggtggccctaaggctagacccagcccacaggtgggacgttttttgttttttaaaggtcagtttccaatatttacaaattatgaaatatgacaaatctggatttgtaatgtctcttgaaaatcagaaaatctgtcatctctaggccagtgtctgtgatggaaacagtaggagatgcccttgtccctcaagcagccacaggtcctgggaacctctcaccttgcccatccttccctgtgctcatttacagcataggtgtggccctctctgctgcctgccttgccagcggtctctccctctccctctccccctccccctccccctccccctgctcctgacacctgagtttttctgcctctgaacaaatgccagggccttcccccatactcttacctctggctagaactccccgcccccattgcctctctcttcctacagacccgcccagataaatcctactcatcctcaagccatgagtttagatgtcactgctgcaggaaaaccacccccgatgccctaccagaggtcagtgcctattttcctattacctgtggccattggtcaattgccctcctgtgacctccgaagggcagggctagcctgatgatctcaccactctaccaccagcagccaacccaatacctggcacaatacctagcacacaatagaagctttctacacatttgttgaatgactggataaacttgacgcctctgggttagtgtgcacgcaagtaagatgccatcgactggcgggacaagatgcggaagcaaacggaaatcagtgtgggagaggcacaggtgcacggtgtcctaggatatgctgaacagtcactatttgccagcgatgttttcccagaggaagtcaagcttgagtggggcttgggaatttgggacttgcaaccattcctgttactgaagaggacactgggtcagagaggtgagtcgaccttcccaaggtcacaaagtccttgcagtctgagtaagaaagacgtgggctgtacctgatgtgctcaaagctgtagctccagaatcaactcaatgttttaacaaatgtggtgaatgaataaataaagggtgaagacagaggttgaagacagaccttacggactcaagcaggagaaagaacttgatattgatttataaacaaagtggaatttggaaatgatccccaaagagaaaagtttagctctactgaggtaaatatttatttactttttttactcctaaaggacaatagcactcttcattgacttttaaatgtatttttgtttagggagctgaggctgttatcttgtttttattatcaacatgtggtggttattttgagaattttaaaatatctttagaaacaaaaagcaaaagagtctctttagtttggaacctcacttaggttgagagactgtttctaacacactcgcaattaattatagaaatcgtcatgcatatgacaaccacaaatgtaaaatgtgagttgtttctgtttttgcaaaagaagaaactaaagtcatagccgtaataacccagaatggtcataataaaagatcagaagcagatgcctctgaggtgacctcgattggctgaaatataaaaagtcacttataatatcacagaaaagtacacttaagaatggtcaaaatggtaaactttatgtggattttaccacaataaaaaatgttcaaaacatttaaaatttgctttaaaaatggaatacagtgattcctccacttataaaaccttccactgaatgagaaaggagctggccctagagtcagtgaggctcagtagctgggacagaaaggaccctgtgggcagaattagccccttctctccagagcgcccacattcccagaaacaccagtgtgatccatccttggatgtgtaagacacaacccatacgtggctttgaaagcacacagacccgggttctggtttcagcaccaatatgcccttgtttgtgagagctctgtcccttacctctctctgcttgcgtccaaggctgcatatctgagctactcacaaagtagctgttaggatttgagcagcataacaaatgagtcttttacataactgctctaggacgtgcgaatttgttatgtttgccccctgctgctagaattcagctccacagggagctgtttgtctgttgtgcactgttcgtgcctagaacagtctggcatgaagtgggcattcgaccatcattagtggtttaatctctgcctaccctcctgccctgcctgtgtgagtgggaaggcagcgcccctgcatccctgggaggcatcccctgggaggaatcctagcaagtccagtggcctctttatccccatgtctaccacctcagtcgcagctgcatccttcccttaccatgtgtaccaatagcagcagccctctgcctctctcctccccacccttcccactctagtctacacccaccgcctccaccccagagccaccttctaacactgatctggccatgtcaccctccagctccagtgccatccagggcttcctattcccccagggtgaagtctgtggtggctcagtgaacagacgcttcatctctcaccctccccatgcctgctttctcctcagccccacagccatctgagttctttcccagggctgtgccccatcttgagccttttctttactgatttcctttctctggtatatcctctgtcccaatccccatcatcacctgcctaactcctgcttacccttcaggagtccatttagaggccacctcttctaaaaagccttccttgagtttaccccaccccattcgacctgagtgaaatgtttcttttctccctgctaaggccacacagcaagtaaatcatcgaactgggattcaaattcaggcccacctgctcccaaaacagcaagccaaaaccggaagactctacttacttatctattcaggaaaaaagagactaaagaatgaggtagagctaagctaacgtcttgaaaagatgcccaaaatatattaaatgaaaacaccaggttgtagaacaatgtgtatggcataattccatcaaagccacaataaactatatatgtttatataggtttttaaagcacagaagatgcctaaacaaacacaaattgagctattaatgataattactgggtgggtggacttaaacattctataaggtttcaatttgttatgtattctttatgtacttaaaaaaaataaactcaaaggaactccacaacttttctccaataataagtaagaggcttgaataccagaaattgcaaaatacagggaccagcttttggagaaaaggctccttcctgcagtggtaacatgagatgagagcagatgcggttgaccagggagccacactcacctttcccagcagctcgggcaggcccagaagctgcccagtgaacacgccaatgcagataaagatggcagtcacctgccccagagagccacggatctccttgggtgagatctcactaaggtacatggggagcacactgagggcgacgcctgtagagagaaagcatagcagcagttagagaggtgtcttcccgggggagctgcactctggttacaatgcctctcttggctctgctttgccctggacattaaatagcactgtagccacggcatttttcccagcacttagcacaaattgccaaagctttcccatgaactttataatttaatcctaaagtatgactggaggtgcatttcagaggacaggacacagctgatggtgttggtggaggtgatggtattgatggtgataatgacggtgatggtgataacggtggtcgtgatggtagtgatggtggtggtgatagtgatggtcatgatggtgatgatgatggtagtagtgatggtagtaatggtgatggtggtagtggtagtgatggtaatgatggcgatggtgacggtgatgatggtggtggtaatggtagtgatggtggtggtggtagtgatggtcatgatggtgatgatgatgatggtggtggtgatgactgtgatgatggttgtggcaatgatgatgatggtgatagtggtggtggtagtagtaatggttatgatagtgatggtggcgatggtggtgatagtgatggtgtggtggtggtggtgatggtgatggtggtgatggtggtcacaatgataatagccaatacacatagtggctaccaagtaacaggaatccttctcatctctttatatgtattaacgttatttacttttaacaatagtcttctgaattaaatatactattaccatttctcttctaaagattagtaaactgaggcacagaaaagttgagtaacttgcctaaatcaccaagtaatgtccagagatgtttaaaaaaattattttgcccaatagagccccagtgggtctctgatcttagaacttgcacttttcccaccagctaacattgcctcttgtcataaattatgggactccgttatggcagatgctattatactcattttataaaaatataatagtttttttctctaaaccttctagatgaagaacactccaggaagatgccctgttgtcctattatggtttcaaatactccgggagaacctggctggattagcaagtcttagagccttctatcatctcaaaatccttcaggtttatcatttggctttaaattcttttttttttttttccaagatggggtttcactcttgttgcccaggctggagcacaatggcttgatctcggctcaccacaacttccacctcccgggttcaagtgattctcctgcctcagcctcctgagtagctgggattataggcatgcgccaccacgcccagctaatttttgtatttttagtagagacgggtttctccatgttggtcagctggtctcgaactcccgacctcagatgatccgcctgccttggcctcccaaagtgttaggattacaggcgtgagccactgcgcccggaccggctttaaattctttattacaaacagatcggccagttcaggtaatagcagcaatattcctttctttctgaccaattgtctcaccttaagtgccctcgagttcttctctctgctttgagagggttggtgagaatacatgacatgaagtctccaagtcctggcgtgactccaacaggccacgtgccacaagtcggaaagaccgaagttttttctttccttcttgttcttctttctttcctgcttctttttgaaagctcataggaaaaagggtctaaaagacatttgttctatctctgtggttttgtaaaaggtccatcttggaatgcagcttatttttagttaaggaaattcagagatcaattagttatatgttcgaagggtcaactccccagattagtcaaagcaacaagaaaggggataatggataaaatataaaactgccaaacagagaatctcagttgcctccactaggaaaggacttcccagaagatccactgcaacctcatccaggctttctccaaagcaggcagggcctctgaaacccaaatcctagatctgtactttattaattaagaacacaaataacaacaatgacaataataccatcagcattcctggagtggggcactaagtgcctggaactacactaagtacttcaatacgtagaacatcgtttattttatttatttatttatgtatttacttttgagatcgagttttgctaacgttgcccagacgggagtgcaatgggtgatctcggctcaccgcaacctccatctcctgggttcaagtggttctcccacctcagcctcccgagtagctgggattacaggtatatgccaccatgcccagctaattttgtattttcagtagagacagggtttctccatgttggtcaggctgctctcaaactcctgacctcaggtgatccgcccgcctcggcctcccaaagtgctgggattacaggtgtgagccaccgtgcccggcccatttaattttcacatcacccaacaagggaggccttactgctaagttgccacgccaggtgggaaagaggccaagactgtgaggtcaatggttgctgcagtggtccctgatttgtaccccctccctggatcgacatccttggggagttagtcctctctgacatttattctgcacgtggccatgggacttgcttgggccaaagggacaccagcaaacgtgcatgcaaagtgcttgcacattgtgcacattgggactttctcctttggctgctgttggaagcccaagaactttatgcaaggcagcccaggcccccctggcccagggtgggaagccaagaaatgagctggcccactgacagcccgtgagaccaggccacctgctaacacccaaacacaggcgtgagaccatcccaggtcatccagccactgaccaacctgaagccaccgcagacacatgagaaggcccagcagagattggcagagctggcccagagcagaactgcccagccgacccacagaagtgaaagcacaggaaaatggttactatttgaagccattaagttttgttttgttttttaagagacagggtttcgctctgtagccaaggctaaaatgcagtggtgccatcatggcttaagtttcggggtttttaaatacatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgagaaaacagtctttcattacaggaggagatcaaaaaaaatgaaaagcatgaacacagttggtcagttataaaacattacatagacaccagccattattcttatggataaactctcaatagccatcaatagaaggagtctattcaagtagtatagacaaatgaatagacaaatgattgaggagtcatttcatcttgagtttggactattagagaggcctagattattcccctccagcagggcaacaaaagtaagtgaagcctcctcttctcaaccttacttccaggcccccactctcctgctcacctctccctgagacatttttattgttcatctcactcagctgaacaacctggtaccctcagcttttaagacatcgacaaggaagggaattagcctttaagaagctcatgctaggttccaggcagtacatatgtgtatatgtgtgtgtgtgagagagacagagagagagagagagacagagtgtgtgtttccgttcagccttattatagccttttgaagtaggtattattaccaccattttacaaatgggaaaaccaaggctcagagccattaagtaacttgcagcagaactgagatccaaactcagggatttctaatcctaaggcttgcaatctttccacaaatgcctaaaagtgatactttatggatttgcctatttagaaagagagcagcgtttgtctgacaatatatcttgagtctcctactctcactcccatagccagcatctgtccccttctctgcagctccccacctagcccagtcccttcccctgaacagctggctcctctgattccactcctggcttcccctcatactccattactggaacaaaccagtccatgtcacattcatctcaaccctccctgcatactcggcacaggcacacagtcctcgccgtggcctacaaggtcttatgtgatctggccccagctcctctttggcgtcatcagcacccacacatctccttgctctttcccagacgtgccatgcctccttccgcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactgtctaccttatgtatctgtctgcccactagaatgtaagctccagggacagggtcttgttaatcattgtgtctccatcctatagtgtgccagccctcgcaggtgctctacaaatgcctggcgagtaaatgaaataacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacagccccaaacacttctcacattttgggacacccccaaggagtatgttactgttccctccccgtcatggtgaactctcacctccatctatgcccatgatgaagcgtcccacgatgagcatttcaaaggctcctgcctggagcgagcaggccatcagcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaagactcaggcacagtgcagggagcactggccttgccacctctggctgtgtgactgggttcagccctggggtctactaggtcacttacaaaggcaccatcagccttgacatctatgaattctctgtggtagtattttattgctttaattctaagactatcatttaacatttctgaagtcagtggtcatcttacaattcgtgagtcagggtccaggcaggaaaatggaaaccactctaggtattttaatggagagaatttaacatagggaattggttaagtggatattgaagaaccgagatgtcaaaaaggaagacctctgaagaaggggtgtttcccatgtggtgctgacacctcaggggcatggaggagggccccgaagacctttgagagtgggcactgtccactggactgtttcctctgaggagcaatatgattctggttctggaaatggacaaaagttggaagctggaatcaactgccaatgtcatcactgggactggcaggaaactcagacaaacatgaaaaagctagtcttttctctctcctctagtgcccctattggcaaaggacaaatgggggtgcaggccccagccccagcatcagagagagagagcccagaagggtaagtgtggagctaggagacaacagcttgacaaccagcatagcgttctacaacttttgttggctccttccctccctccctccctttcttccttatttcctttcctttccagtggctcataaaataacaatactcctcagacccaatggcatcttagatttgatgaactacagtactaagtgaatggctggactaatcctctcaaacaagattagggaaatttccatggcaataattattattaacagctctgtgtcaggactgccatcacttttataaacacatgcctaagacctcatggttcaaatacctgacttgtttggaggcctggggacctggattcctgcaccagctctatccttcaggagctaggagactttgaacttcatttctctgtgttttcttttcctcacttttgcaaaatgatcctaaaagcccacatttattgaactcttgctataggatagaccctgctttaagtactttgcattagtagctcatttaatcctcagaatgacccaaagagataggtactcttataatctctattttataaacaagttaactaggttgctggcaagctagaaacttgttttatttttaatttttatttttgagacagagtcttgctctatcacccaggctggagtggattggcacaatctctgctcactgcagtttccacttcccaggttcaagtgattctcctccctcagcttcctgggtagctgggattacaggcatgcaccaccacacccagctaatttttgtatttttagtagagacggggtttcaccatgttggccaggatggtctcaaacttctgacctcaggtgatctgcctgcctcagcctcccaaagtgctgggattacaggcgtgagccactgcgtccggcctagaaacttgttttaggtcatatagtcagtgagtcaaggagttggggaaacatcttagccctttacggcttattttttttcctatagactcaatgagttaacagatattaaattgttttgtaaattgtggttaaaaaattattttgcccaatagagccccagtgggtctctgatcttagaacttgcgctcttcccaccagctaacattgcctcttgtcataaattatgggactcagttatggcagatgctattatactcattatataaaaatataagtttttttctctaaaccagcctctcgggagactggggcaggagaactgcttgaacccaggaggcagagattgcagtgagccaagatcatgccaccgcactccaacctgggtgacagagcgagactccgtcttgaaaaaaaaagaaaagaaaaagaaagaaagaaacatcagtgaggccagcctggctggaggcagtagggagccagggagcaagcagtagaaagtgaaagttgagaagagaaaagaagaactcagagagtcttctatgccaccataagaactagcgtttcccccctgggggagatagcagccactgggagattccaaggagaggaatgacaccggctaatacttgaacaagatcactacatcttgtcttctctgttgctcctggactgcaggggacaagtgtgaaagcagggagaccagctggggagctaccacaacaggtgagtcaaccactggtaatgatttggaccaggctgggagcagtgcacttagtgagaagtggtcagatcctagcatattttgaagagtgagttggtgggatttgctgatggactggacagaggtggagaggcatagaggagccaaggatgcctccaaaagctttggtctgaacccttactttggacatgatggtgtattttgtgctaattttaaaactgcatgaaaggtttgtgagaatgttaaaattatatgaaagtctgacttgaaacatgtgcaaacgggagtgcacactctctgggcaagtttatcatattaatatattccttcccaaaataaccctcagcctgacagcattgcagtgaggatggaaatgtgtgcaaatcctttgcaaagctgactcactgggcttcagagcaggactttaatcattgtttccatttgtttcctgtggatgaacagcaacataaacaagggagatcaattctgaaagcagaactccagtgtccccagaactccacctaggatgcctgattcattgtttttagcttctccaatagtgtagaatcttccccatgaaacccagaaagtcatcagctctcaaggggaaaaaaagaccaaatacaaggaagcatggtagggtgatgaggagattggagggcatgtcccttcagaagtgtcaaaggggctggagacatttcgcctggacaagaggtcagagaaagcaggagagccaccttccttcatgccatgctttaacttggtgcagagcaccaggacggattgggggaagacatagggaattctatttcagtttgaatttggaaagtacttttcattaaaccctagtagaccagagaacctatggaaataatgtatctctccacagacctttccagtaaatcttcagcctgactgggcctataagccaagatcatgccttgtttccacatccctcaccctcctcgtgttcatccgttcctgcatacccagcttgaattccttggctcatccctttaaatatttatatgcccatccaccccctttcattacatatgcctggcaaaaccccagctggttaaatctctgtctactgggcatctacaaagctcagcttggctggagaaaaacatatggctgtgttgtcctttctcacctgaaattcatgaccaccaacctcaagaagggttaaggctcccctgcactgagtctacagattcctggtccatccaacacccttctctcctagaggactatttcatatgttttctctctctcttcaaatcccctttttatcattctcagctgatgaccatgctttctttttcactgagaacacagaggcaatcccaagagacccttcccacatgccctctgcttgtatttctgcacctgcatctgtgcccagacacctgccttcccttgttttccaaccctggtgcaaaccatgtcctctctcacctgcgctattgcaaggttctcccaaccaggctctgagaccccctgataacagcacacctttccaaatgcaagtcagatcagttcttaaaacgttccactgacttcccattttgctcagaggaagagtctcaaccctcgcctgcaaagtcctcaggatctgactccaaatatcccatctagcttcctatgattatctctacactgacctccactctcatcttcaaagaagtggagcctcttcttgcccctgggcttttgcacctgctgcctcctctgcttggagagctatttcccagggatgagcgtgctcactcccttgcttccttcagtgctccctgcacaagtcaccattttagagaatcctctgaacaaagtggtgagctcttcaccctccccagcatcttctgacctccttgagctgctctgttttctacattggtccttgtcacaggccgaatggcacagtctgcatgcttgttacttggctgtgctccccgcttggctgcatgcttcaggaggacagggactttggcagctttgctcatgcctgagtgcttggcacatagaaagtactcaacagatatgtggtgagtaaataatcggatgagggaacggaaagtgtgcaagcatacaaggatgcttagatgcaagcaaggatggccacactggggagatgtgatagaaaaattcaagcatcgagcattttccacccatccttccatttatccaacaaatgtctactgcttgcctgctgtgtacaagctgctgtgttgggtgctaggggccataaatacatatggttcttacgttgaagggctcccttatcagggaagagacgggaacataatgaaatgagtacaacccaaaatgccaagtgacgtaacacagggaactgaaagtcctgtgtgagctcagagaaggccaatatttagttctggtagatatgtcctaggcagtgggggatggggttgaagatttcttatgatttctaaccctgctttcccggctcatgcgtctgtaataccaaaggggttgtgtccataataaaacaaaccagtgatgcagggacagcttgtaccattgaagcctcttgttttggatgtgttgactctttgttttacactttggaaccctgccgtcccgaagtcttctggtcttatctaccatgcccaggctttctccttatgtcccatcatgaacccaagtttccttcttccagagttcttgccattctcactatgcttagaagactagtcaagtcttctaaggctgggagaagcagggttgaggatcaggtttcctggctggctggttatctccctatcccctcagggattcccccagctcaatgaatgctggcttctaaaggctcagggttgactcttctccagaagattgacattggctctgaaggtggatccccctttcccagtgctgcctgcagcgagtgacagatgagtggtaggggtggatgcagcccccttacttcaagttgggtgactctgtggtgtgattatgccccagagctcccccaagtgaggctaaacttgaccagggagtgcagccttgcctggctccttcccctgctgctttctgctttccccaccttaaagattactcctgaagagcccttcctccacaagccatgtgtgcatcccaatccctgcctcaggctctgcttctgggcaattgactttctgagacaattccagcctgaaagaagaggttgtcagcagcacggtgtgttgctcagtcatggactaaactatgttcctgccccctggttgagaacccttgaacgcatgtaacctcgctcgggccaaggagattcatgcctgggactttaactacaatgattggaaggagaatttccatcaagctggggccatcttgcacctccacagaagaaactgcctgacaatgaagccaacaaaaaacaagctgagctgagaggtggagaaagagagagatttggatttttttaaggctcacctgttaaagccctaacccctaatgtgactgcatttggggacagggcctttaaagagataattaaactaaaatgaggtcacaaggaagcggccctaatgtgggatgattggtgtccttgtaagaagaggaagggacaccagggatgcacacacacagggagcacacagcgagaaagcagccatctgcaagccatggagagaagcctcgggaggaaaagacctgccgacactttgatcttggccttccagcctccagaactgtgagaaaatgaatgtctgtttgctgaagccactccatctgtggtattctgatatggcagcctgggctaaccaatgcatgcttgccacatacactgaaggctcctccagcaggcacctagagagacacagttattttctactactataaaatacagatgccttttaaagggttgaagtagaaaatgatgaaagcaaaaatagtccttttgacaacctgctatttccctggagtgatgtatgggatgcctgttgtttgtgctcaccgaacctccatccttcttctgggaggagttcctcaaatttccaccaagaaaccttcctgcctgtctccacctaaccatggcttcaggagtggatgcgtggtacaggcctggccagtcaacataaaatcactcatcattctcaaggcatttaagatgtgcttttttaaaagcacttaatccagagtgttagaatgttatttgccaggattttctaaccttggcactattcacatttggaactggaaaattctttgctgtgggggttgtcccgtgcattgtaggatatttagaggcatccctggcttctcctagatgctagtagcacccttgagttatgaaaaccagaaacatctcctggcattgtcaaatgtcccctgatgaggcaacattgccctctggttgagaacccttgaacgcatgcaacctcgctcaagtcaaagagattcatgcctgggactttaatcacaactatcggaaggagaatttccaccaagctgggcccatcttatacctccatgggagagattgcctgacaatggagccaacacaaagcaaggtgagctgagaggtggagacagatttggattttttaaaagctatcatctgagccactggattcaaccaagttatattttagttattgtgagccaagtaattcccttttgggcttcagccagtttgctttgggttcctgtcacaggcattcaaaaagcctccttagtgacatgagacactgtaaatttgatctcgttccaccctcatagctgctccctcaggtgggtttgtttatctgcactttacagatttaaaaattaaagggcatagcagctgcctcttgtatctctaccatccatgcacagcactgctcagaatcataaagacttacataatgaattactcaggggctgcctcctttgcccaagcatcaccttaagccccagatgttgtgtctttcttgttcactgaagccccagtgccaaaaacagtaccttactccttgtaggtgctcaaaaatgtttgtttggatagatgaatatggttacgtggcttgtccaagagtctggcccaggatcagatttcaaagcccatgtgtgttttcctatagtttcttatatgttttttctgctttgctccagacggaagaaccagatccaatgatatgtgtaagaagaataatttcagtgcaattgaaagaacagatgcacaattgactctgtcaagtgatggaatgacccgtctcaaataaagccaatgaggttggtgatggtgaagatgatgatgatgttgatgatgatgacactagtgaacaaaggctgggcgaagagtctgggtcaattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggcccgtagctagtgtttgtacaccaaacatagtcactgtcctgtctcatgagggaaggagggtcctgtcactatggtcatgcaagcagaggacagaggatgctaaatgggtcactgagcttcaaccagaattcttgatcgctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagctaggaacagccccactgctggagcagccagtgaccagccccatcggaactcttccccacttccctggaatgtctcccccagctatacctttgagcaccttccactgggcctcccaggctgccattgcagtttcctctccctccctgagaatccccatgggagaggaataacagagcatcaggaaggcgtttcaaatagcatcatgtcacaggaagagtgttggcctgtggtcaaacacatgcagatctgaacttcagttcaactccattttgaaaccttggtccaattgaccactgggtcttggactcatcatttgaaaagtgcaggtaatgatgcaaacatggagttttaagaagtaaatgatatatgggatgtcaaggacaaggcaggaggtcaatagatggtagctttctttttcaatttttgctccttttctccccagcagagttgctcttcaagctgaaacttcagcccaaatcaacttttactctcataatgatgaaaaggaaactggcagctgcttggggcataacaaccaacacatcctttgatctgatctttttctgcatcctcacttctttatgactcctccattacttagagattgaaggtattttcaaagttgttttctcttttgctttccttttccttttttttttttttttttgttgccatgccagtgagggtagtaaagctactttcattgccctcattttataggtaagaataatgctggctgagaagtgaggtgtcaaagtcccttgtaacacacctgatacacagcagagtcaggacttgctgagccacggcattctgacccgattctagtgttccttttcctattccatctgcatgggttcagagcctccttgaggagcagccttggggtataaatgccacggtcaggtataaagcaaggagacatcacaggccagatcctggggcatggggagtgactccatcccactaggacaagcaagaggaccatgggcagggtctggcttgggcaggaggcttagtgaccatgcctcagggaccctggccagtgatgccaatctgagtgccagcctgttgtcaaacagtcatggttttacagtacattcccagcattgggaattggcccctaactaagatctgcttggcatagtggaaagatcatgattccagcctaagctcagccacagtgcaagctagctaagcttgtgcagatgccctcacctctctaacctcccattccccatctacagaccccacagcagatagaaaattaaacaagagaatgtgtgagtggctggaaccttgaaggacctcagacaatggcatctctcactacatcatgcagtagttgtatttccaggccctgaattcccattaattactgctctgaaagtgggcttggggacaaggaaaatgtcagcacctcccctacctcacaggtatcacagaccctcataagcaccacttggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggccccatcagattgatgtgacgactcctccatcacttggagaagctctactctttccacacactgctcactggctcccaggatgctgttgttatgaacaagaatacagagaaagcattgtttgtggggattcattgataagtcaatctgctctgagagaaggattcctgtctaaaataagtgaggaatgaggctcacaaggtcaagtgagctgattggagagggcctgggtaggaaaggctgatatgaagtttttgattctcactgcttccttatttgtaatgtaaatgatctgaaatgacctaaatgtctctcagtcagggagtgtggctaaataaatgatgagacagccatatagtggaagactgtctaagcagtcaattttctggaaaagcagatctgtatgtacttacgtggaacaatttccaaggcactgcactgtgttttccatttgccccaacacccagatcaattcccctcccctccctgctctgctctatgccccgggagcatctcctggatggcaacatgacttcctggtttactggctttcacatgggtgtgaccagtgtgcacctctgcagcaggatggagggtgggaggagggaggggtcagggcatttcttccctgctcctcccccatgtgggtgctgtggctctgacacagcccagtccctatacgcttctgctgctgctcatcagcctgcagtccatggcttcagttatctttggaccttggtctctgatttcttcccctttcccctttgggcatttgaatctctccagttgaactgcctgagtggagttctgttgcctgtcaggaccctgacaatgacacagatatattatgaacatggagggcacccccagatagagacagcctcctactgacctcccaagaacctttccaatcatcttcacaattaacgtccccacaagtccaccgatggcgaatatggacacagtcacagaccagagcaaagtcagagtgtctgggtctattggacgtccatgccttctttcccatgactcattgtaaaaggccttgatgtactgaaaataaacaacaaaccatgttatttccttctgttctctcctgctgcttgaagcaagccagtgtacaaaacaaaacagcttgtacagagcattttcatgcatagcactttgctaatttgtttgagctttatctcattggcctcttctaacaaattttgggaagagcagaagatgttaatctttattatattcaaatgagcattttttttcttttatggctagtttttttgtgtttcttgcatctttgcctatcccaaggtactttttttgtaacaaaatgtttcctctttttacctcattttggagatagggaaactgaggctcagggagacaaagtgacttgctaggtaagtgctaaacctgggagctggactcagatctgaccccaagcttatgatgagcttcatagctgggcttctccaattctagtgcaccgcagcattgctgtggaggtgtgttaaagggcacataccgggtgggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctatctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaaggaaatacaacttcacattcactagagtctcatcgctgccaattctgattcagtgtgtttgggacagggactaggtgattctgatgtacaccaaagactgaggtccatggcactaagctccaaacagagttcagtccccaaggtacttagagttccctgttgctacccaacgtgagcccgcaaacctcagctgagccagtatatgacactgcagaaaaagcttaggttcaggtcgctcagacctgggctcaaatcccagcacaacttggtaatgatttaaatcagctgaaccttggttttcttatctgcaaaatgggaatgatgacattgacctctcagggctgttgtgagggtcaaatgagagcttgaagcagtggccagtacttgaatggagcttacacaatcccacatagactaaaaattaaaagatctggtaagactgaggagtgacaagcagtgtgttgtctgctggtaggagtttgacttgtacagccatcttggaaaacagctttggcatcagctagtcaaatggaagatgcctgtagcctacaactcagcaaatctacttctagaaaactcccctgaaaaactgtttctggggagccctaggatatatgtactcagatgtccatggcagcattgcacataataactccagacgagaaacagcccaggtgcccatggtcgatagcaggaataaacaaattgcagaatcatcatcatatgaaacatcacagccacaaacatgaatgaatacagctctgtccaaacacacatgggaaaacctggcaaaaataacaccaaccaaaagcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttctttttttttttttcaggctggagtgcagtggcatgatcacagctcactgcagatttgatcccctggggtcaggaggtcctggtacttcagcctcccgagtagctgagacagacgactacaggtatgtgccactatgcctggataaattttttttgtttgtttcttgtacaaaggaggtctcgccatgttccccaaggctggtctcaaactcctgggctcatgcgatcctcccgctgcagcctccccagaccttttattcttaacctggattgtgacatgagtgttagatttatactcagtctttaaagtgtgtgtgtgtgtgtacgggcacacaagcataatgcatatgtgtgtattttatatactcttttgtatgcataatacatgctgccatttaacatggaaaagaaaaatggtaggaaagtgttccaggcagagggagaattatgccaagacagcaggacagaagaaagcttgggtggccatggaattgcaaggaggccaataggggaggaacaggaccagaaagggaaggagtgggctggatgaagttggaggggcaagaaagggcaggtcatgtgggcctgataggtcatggaagttagcctggtttttacttggattctactctagatgaagtgggaaagtattggagggtttttggcagggggaggacatggtgtggcttgcattttcagaggatccctctggcaagtggatgaaagaggagctagacaggaagccaggcacacttggggggcactgcagtggtccaaagatcatggtggacttcactaagcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagcaaatggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccagacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatccaggtgccatctggttgcttcactctgctttccataattttgacctcatcctaagacagcatgcactcacaattgcaggatggctcctagtagcagttttggctacatgcttttctattcatgcatgactggagagagtaagcttggcctctcataggtctcttggtgctaagaggaactttcccggaagcttctaacaaacttctctttatgtcctgctggacatagttggggcacagatcccttactaaaccagtgtggaatgggacccatcagcctgtacctctgcccctgaattcctttcctttatctgttcctccctacgtgagtgaatgggaccaccattctccagttgctcagccaaaaaccacgaagtcattcttaactcctgcccttgatccaatctcctcaactaatccaccctcactcatccctgactgttagggttgaattgtatctaacctcacacctccagatttatatactaaagtcctaactccccaaacctcagaatgggtccttatttgaaatgtggtcattgcagatataattaattaagaagaggtcatattggagtaaggcccactctactccaatatgactggtgtcctttatagaaagaggacacaaagacagacacgggtacagagtgaattttgttcccctccaaacttcatatgttgaagtcctaacccctagtacctcagaatgtgaccttatttggagacaatctttacaaagcaaataacattaaaatgaggtcactagagtgggccctaatccaacgtgactggtaccctgataaaaaggggaaatgtggagatagacaggcacaggaggaagatgatgtaaacaggcatggggagaagatggccatctgtgagccagagagagaaggctggaactgagccttccttcaaagccctcagaaggaatccactctgccaacaccttgatcttggacttctgacctctagaactatggaataacacatttcagttctttcagtcactcagtccgtggtactttgttacagcagctctagaaaagtaatatattgcctagcttccaaaaggcttctcaccacttccaccattccaccactcaaccggtccaaactgccatcccctcactggggctaccaggacactgattcctgagccttcatcagggtgctaccagcagccttcagaatggccactatgttctttcttagtggctggacatttacctgacattgaccatttagtcaatgtcaaggctttatgtcctctattggacatttatctgccttttaggctccccagcatcagaagccctcttcccgcctgggagactttcctgcctcagaatcctgagtggggaaacaaaggacacataactacagaagccaaacatgccagacacccgctctcccagcatcctctgcagctggaagtggacatgtgaccaaggctcagccaatcagatgctggaactttgatcaaggtgttactggggctaagacatggggctgaggaggattctccagcagcagagggagctctggtgggattgggtttgggggcagcagcaggggagctgcaatgtcctgtgccagcggtgcagtcaatggcagtggtggctgcagcggagcccataggaccagctctgggagtgatttagggtagtatctccagctacagagcttccaggcctggctctccagccctcccactgatcctgtgagcaacccactcttttcaacaacttttttggctttagttgttccttacaactatggaaatacagaaactctagcaaagcacataaataatctcacttcaccctcacgacaaccctagtggtaaaagccctcatttacaaacaaggggcctgagagttatataacctgcccacagtcacggcttatatgcactgggaggcttttgtggtggagctgccaaacttcagggcacaaatacaactgctccacaaactgaactcttgaacttatgattaagatgtgaaagttaagcagataaacctaatggtgcatttattgatttaagagtaaatattggctgggtgcagtggctcatgcctgtaattccaacactttgggaggccaaggcaggcagatcacctgaggttaggagtttgagactagcctggccaacatggtgaaaccccatctctactaaaaatagaaaaattagctgggtgtggtggtgcacgcctctagtcccagctactctggaggctgaggctggggaatatcttgaaccctggaggcagaggttgcagggagccaagattgcgccactgcactccagcctgggggactgagcgagactccatctaaaacaaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcacgtgaacttgctccctatggcactcttatagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctctatagactctggaggggccagaagacttgctgcatagcctaggccccctgcaggaacacttttctcaaaagttccccgaaagctgtttgccccaatgcttttggcaactgaacgtttgtcttccaggtctgaattcagcaatagcccaggtgaaaggccttgttaccacaaggctgaagccagtgatgaagtttgctcagagaattcactgcactaacattccccaagcttgagatttgtgaacctcacctatggcaaaacatgactggtcatgcatgatacagaatgggtgcttaaataagaattcgttttgagtttctgctgtgtggcagtaaccatataataataaaacaggtaacccacacatcatagttacaatatgctctgtactattctaagaactggaggcatactgactcacttcttaccctccacaagggtactatttgttacctctgttttgggcagatgtggtatctgagccacagagccacaaggggccctcccaagctcacaccattggcatgcgatgtcaccaggactcagccccagtgagcagggatccagagtccatctcttaaccattacttttttccaactctaagtgtagaaaatataaagatgatgatatcaatacctctgttttaggggagaagaggagacatggaatgaagattggttgactgctaagtatgtatcagacatttggatatctcatctcattcaacccttgtagccatcctgagaagtttcattcacaacagagaagtctggagtggagaaacacatcccacagccatgccaaagatggtagaactgcagggcctgctagacctcacagtgctctcctcttcctggacatactgccaggccaccttacccagttccttgcatctaggtggggccatatgactacttctcaagcaaggagtgtaagtacaagggacatgtgtgacctccaccaagacgctgagaatgtgtttgcctgctccacgcttgctcctgtcagctggccagccacagaggatctagcagaggactccaaagtcctagagaatggtggaaccacttcacttaaggaacctgggtccctgaatggcttcatggagcagagtgttcctgctcatctccttcaaatgaggtgatataaatgggaattttcactgtgttaagccactgagatacagggcttgtttattacagcagcaagtttgccctgctgacacaatcaacgtaactacagagcccatgccatcacaattgcactgtgacctgaggcttcaagaaggaggagagatttaggccaagtcatgaaggcttggagatataaacctttacctagagctttccttttatgtgttgggagaactcgatcctgtttgaagaaaacaatctgcaataaaaatttgctttaagatcactgtggtaggtaacctctaggcctgctttgggacatctcactcattcctatcttacttgggattccttgttttactttttcattcagccaacagccacgaggcacattcttgtatctttctatctgactttacaggtctgcttcctcactaccaggggcccagcttcccatcctttcttctagatacaaattctgctgtttcttgccttcaaggagttcaagatctagtggagacagtagtcaagtaaacatacaattataacatggaataaaaatgccatgacaataggaagccaagaaaggctgtggaatccaagtcaagcaagcaagaagggcagacggagtgggctcagttacaggacgacaggcagagttaacagaattcttgaaggtgcagaaaccggagaccacaggttgccacacaggaggtataaaagacgcagtgggttgaaaggtggcccagtagaaggttggaggctgcctgtacctggctttgcctgccagcctcaggagtctacacaaaattccatgggcactggggagccattggagggttttagcacggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttacggctagtactaactacagcctaaactgcaaacaactgaataaaaggctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtagttggaattggcttttttccactctcagctctgccacttctttgctgggtgaccttgagtaagttacttaacctctctgcgcctcaggttcctcatctgttaaatcattgccctccttgaagagttactgtgaagatttaatgagagaatgaagatacagcacagtgctgggtcgatatgaagtacacaataaaaaccggaaattggggtggttggtggtagtgttgttgatatttttactgctatatttgtaaaataaggggcctaggctcatttatttgtcagattcaagaatccatgaatcacttaccattatctcccaggccaggaacctggggaccaagcctctggacataaaattgaactctgcaattcccagccaagactggcttagagcatctccaaataataaaagaaattgccagacaatgggaggcaaattacctcgtagcccgtttaacaatattaatgtgccttactgattcacacagagcctcccgtgaactcacttggaacgattctcaggagtcctgtaaaaatacacggaagtaacacttggtagctgggccagagtacacacaccattgcataagagaggaagtcatgccacaatgccttagggctttataaagacagtctgcaccactgaacacactggcacagggaagaacgcagtccagaagtccttaaaaaagtacccattgttgaaccaggccctctgaagttagggccccacaagaacaaaattccacaatcccagcagtgctacctaatgtcgcctggctccccgaggtaaggcctcctgtgtagaaaagagctctcacagcacgcctgagacttctcttcctagaaaagcctgctgcagggtaagtcccgggcttgcatctgggaacttggatgttggaagggttgccaccgttcccagatctggtaagagtgactcagtgtacctaaactgtgcaaacagtgtggtttatgctgtctcagtgtggtttatatctgctttctttctgggaatctggaattttctgcttgccaagcagagagtgcctatgtgaccaccccccgagaaaaaccctggactccaagtctctaatgagtttccttgttagacaaatttcacaagagttgtcacaactcgttgctgtggggatgaagcgcgtcccgtgaggctctgctagaagagttctttggagcttgcccctggtttcctctggacttcacccctgcacctttttcctttgctgacttagcattgtgttccaccactgtgatcagtcatagctgtgagtactaccgcattcctgtgccaacgcctgtgactcatgccagtgaattatcctacctgaaggtggtgttgggtgaccccagtacacctcccttgtcctaaggaaaaaactcagctcccattttggcttgacttgagcattaggtttgcaggtttgtggtgttttttcctcctccccaagtgattctcccagaggagcctggctgactcactgggaaagaggctcctgtgcctccagacacctgagactattttgttcccacagttagctttcagaatgaaatgaaacatgatgaaagaggaaacatcaattacaagcaacagccaggcaagtaaggctttcagagcctcctgggtttcccctcagccacctttgcagtgagggggcagccaaatgcttgggtttaattagttgaaacataaagaaggtaagtttcattgtctatttggccccaggcagaagcagagaagtgaatgcactcccaatattattcttattcaatcacagtcctgagccttcctcctgctggaacattcttttgagaggttgcatagctgtgtttacagggaacagtgcattttcgcagacttgagatgatattttgctctcctttttgcatatcctccggttggccggaatgaaaagggcaaattgttttcattaccagtcaattcacttctggatgcttgaggtagcaggggccccgtctgcaacatcaattctggaataactcatttatagaatgggaataagaacccctagcttgtagatgaggccgccagaaggatgaaatgaggtgtgtgaagtcccgagcatgatgtcagcatacagcaggtgctcaataaatttcagggtcttcccctatgggtcagaaatagggtgcttctagtttcacttgtctggtttgttcacaccagctgtgcaactccaacacagccctccaagtttccctacctcccatcttgctggatcagctatccccagctctctggctgcagcaaccactgcccccactgcactaagctgagcttcctggagatttgatgggaccgagttcctttccccatttggctcaacaaaggcatttttcttggagaaactttatgaaatgagaaaattctatatcaaagaggcaggctgtccagctctaatcgctgggacctccagggcatggtgcggggggagttggcactcacagcctgggacacctggacaccaacgccccaggctggaaaaggtccctgggccctcatcagtcagcagctgtgctggctctgatcaaatcaaaccaaaccaaacaatgactcacagatcccaatttaaacaatgcagcagcatctcatattagagaaaaattggaaacaacctcagaggcccacattaggaagataggacatcacaggaggcagctccacactgctgttaaacatcctggtgatgcagaacttccaatagcatagaaaggtgcttacaaataaatagtaagccaaaaaagagagtattaaacagtatatatgatgatcttcagaaaaaagagtggatttagatgacacattaaaagcggcctctggatggagtctgggttttgactgtgttcaggcccaagtgtaccatctattagctaggtagccttaggccagtcactcaatctctcccttatttgtaatacagggttatcagcataaatctgccatgtggggctggtatacaaatgagagagatcatctctcactcacagaagaatgtttgtatgtgtagcttcattatcaaatttctgtgcggtggtttttttttttttttttcctaatggaagtctgttgcttttatagttactgagataaagtgagacaaaagcaagagtaaaactgaaaagagcggggggtgaggggacaaaactctgggattcagagatacccatttcatagacataattgcccgttgtttctgcagtgacacaatgcacagggtcctcctgtaatctcagccctcttccaccaaagtcttgagccctgctatgcctccccctcaccccaaccagaacttatgtcgtttgacacagtctctgctcatcattccctcctggtttccttgagaatgggtctcaggccacaccagaggcacctgccaggcgacatgcttctttctctaagagcgcctgggttcccagagcagcctgctaagatggcattatggggtgggattaactgaaagcaccagaacttgcttttgggttctctctctgttggttcacttgaatcttgtttgatcaggttctaacatctgtggctaactgggcagctctacccttatagagggaaatgttgattttgctttttattatcatttgtttatctgcctttagggaaggagcagacaggagaaaataatagaatataccatttatgctgggaaatgcattgagtcaacttaattgctctacagaaaccctgggcttaaatactaacaccatgaaggacaagagtctgtgtctcccctcccaagaagacaaaacatggctaactcaaaaaccactggaaaagtgagtaatttcttatcaaagccaagccattcagtattatttctgtggctgccagtgttgtttcaaataagtcctaatttatattggatggtgtggggccaatgagttagactcctaaagttaagttctcattcattctttctcactccttccttctctcactcactaattcattttacaaacattttttgagtattttctgtttataatatgcatttgtgtaatgtaaatcttatatacacagtagacaactgtataataaagtttggctggcctttgtccctggttcttgggatgtagcctgtgaattcttgggatttcttgagttattcatggcagacctctcagaatcccttgatagtgtatgttaacaagataactcaggatgggggttggccatgcaagaaagaccagccatgtgatagagggttggggctttgagccaagtgacatcagccctacctccagggaagagaggaggaccaaagattgagttcaaccttatggccaatgatttgatcaatcacatctacatgatgaaaccccaataaaaatttggaacactgaagcttgggtgagcttccctggtagacaacactctgtgggaggagagagaacaccagagctggaatccttccagaccttgccctgtgatctcttcttgtggcttattctgattcgtatcctttttgctataataaagctgtaattctaagcatagcacttcctgagttctgtgagtcatttgagcaaattatcaaaccagaaggggtagtgagaacccccaaatgtgttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgcgaggtactttgatagacgccagggaaacaaatgaacagtattgttttaggtgacactttgatctgtacaatcctgactgctatacttttgccaagcctccaagcatttcccccaagctacaggccagaaactgcacaaacaggcaccaagttcactgtctacccttttgattagccctgaactgtcccgcccacctcaccttctgttcccccaaccactgcattccctgtttgctttctaatttttattttcattcataactcctattcaacacattcattatctcaactttggtccttttttcttggcgacttttcttaatgtccatcccccagtggtcgttctgcctaggctgactgttctcttgggctcattgcaatgtgggatcctcctacaatcataggaagtgcgtgagtcccaggtcaggaatccatccaggtccatcacctcaatagttgcttctcatggatcagctactcttgaacccctcaccctttggcttgttttttgtcttggttgggcccttttggactgaagtctgggctccatactgtcggccctgccacagaccttgcatttctttagaacattgcttccagaatcttcctgtaggctctgtggacaacacccatgagcaagaggagctttgactcatgctttgcccaggcaccaccatcccacccaggcctgtatcagccctgtctgcccatttcagtccccagagaatgtcccttggggctcagaaccccccactccagtctgtgggtctccatccagcccttaacaacctctcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgttattggcacataccctcacccattcatttacatatcatctataactgctttatctctacatagcagagttcagtagttgcaacagagaccatatggccaacaaagaaaaaccacgcactatctggacctccacagaacatttgctggaccttcacagaacgtttgctgattcacagaatgcagcagatcagcctagtggaacagaaagaagggatactcaggaattagacagaccagtgtccaagtccccatctgtgaacatggtggaggtggtcccagaagttttccataggacagactcacagctggcaatttgtttgagagtgaagagacctaaggacttgccttggactcactttaaatttaaatttatccatttgctcatttagcaaatattttttataaatgcttacaatgtgtcagacattgttctaggtgctggcactgcagaagcaaggacctttctaaagtgaagggaaggaggacaagaagtaaaggaatatgtcatatctcaggtagtgttaaataccatgaggagaaataaattcggtgagggctaaagcgtgatggaggggtgccattttggataggctggtcagggaagacatttctgaggaggggacgtctgagcagaggcaagaagtaatcaaaggagagtgcacaggaaaatcaagggaagagcactgcagccagcaggagcagcacgcacaaaggctctgaggttccagcgtgcggtgtgtttgaggggcagcaagtggggagaagtttgtgtaaatggagaagagggagtgaggggggaaatgatgatgacagagtggtcacatctgtcatgtgtcatgtgtcacggccccaggtaccgtgtaagtcaccacagtctggcttgctttctagatatagtgggttttgagcggagggacaatatgatcttgcttcatttgtcaaggatccctttggcctttgggtggagactaaactgtaggaaccagagtggaaacagagaaaccagttagggtttagtgtagagaatgaatagagcctagctactgtggtgttcatcttggtgatcaacgcaccagcacagcacagataaccctgattttcaacagctaaggacaataagaacctcttgccagttcatgcaaagtccagtgtgcgtttaatagttctctgccatctgggggaagaaaggactgaagatctttcttcagtgctgccataaccagggatgctgccataaaccaggcctcatgtggcctatcagcacctctgttcacatcccatccaccaagctggccaaggacccttgtggatgcacgaggtgcaggtgttctcttccaaatgaggcatgaaaagtagtcagatcctggggattcttggaaagttgggtggccaggaggcacatccaggtgactgtgttgaggagaagccagtgggaatgtttaggaagtgtcccacccctgaaacttggatgtattgggttccctcagcctcagtttcctcgcctttaaaagggggttagtgatagctgccttgcaatattataacaaggatccagtgtgcacacaattctgaacctgggtcaagtgcagagctggtgcccagaggcgagttattttcattttcggcattacagaaagtttccaaatatctgaggagagaggagcactgagcgtttttaaggttgaggctgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgaggacttacaagcctgggccagtgctaaaggcagcacaccttcccatggggcagcatccacacaccaccccctggtggcagcctttgttcatcatctctgtgagcagataccctccccgcactccaaagcagcactaatatctgcacctcttctgttccaagggtttctttctccttctcgagagcccagcaccccaggtgaagcctagctctcacaccctaaacccctgccaggcttgggtccttccagcctgtgttagattccattccttagaggctctgctctgttcctggtctccctggttctggggctgcctcactcacccgtttctaagcccactgcaaggagaagagagaattcgaggtgatcgctggacgctgggctgagctcctccagcatcacatctcctttcatttcgcagcgacctcacaaggggctcgacaccagccctttacagaggcacctacatggtgcctgggattctctgcaggattctgagctgggattctgtgcaggcctgctcagctcacactcagggcagtttccacctcggaagggcctcccagggcgagccttggccctcagcctgctcatagcctgggtggtgctggatcatgctcctgttctggcctctgcaacctttctgatctggcttcagctcccctttccagcctctacctctccaccccactggaccccacatccagctacccttaggtctccaccattcccagaaagccttgagctctctctttcaagccccagtgaggccccactgacctccccaggtagaatacagtccttcagctgtcctgtggctccatgcagcctgtctcactggtgattatttattgagcctctgtcactgctgctggtcttggggcacctcgaggacatggatgtgtgtcgttttcatctttctaccccagatacagcaaggtcaacacccagggaagggcactgaaggattgcctgaacagctacccctctcttctcacaaagcagcacaagtaaacataaaacatcaggacctttaggcagagcaggaagaggttacatgaccccaaaccccatagggaggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgatggcagcatcatccaccttatgcttgagcccctagggttgttgcagtgaaaccttgctctgtcttttggttggtagatggacaggtaagtagccctgggcttgctgtggctcctcccatctccccttgttcctctttgcctttattgatcatgccaaactccccccatggctggactgttggcgcctgccattagtggtcaggggcaggaaggaggggcagagagcatggcacggatcttggattcagacagacctgggtttgaattccaacactgccacctcctggctgtgtgaacctgggcaagttgcttaaactgagcttctgtttctttgttcatgaaatgaaggtaacatcagtaattaactaccttgacctgaattgtgtcccctccaaaaatgttgcatgacatttttgttgcaaggatagggcatgttgaagccctaaccccgatgtgatggtatttggagatgaggcctttgggaggttactggggttagcagaggtcatgggggcggcctcatggtgggatgagtatcttgctcccttgcactcttcctccctctgccatgtacaggcagtgagaaagaggccgtctgcaagccagaaggaaggtccttgccagacaacgaatccaccggcactttgattttggatttccaggttggagaagtatgggaaaataaatgtcttgctgaagaccccaggctgtgctgttttgttacagccaaagacactgacgtctctgtatttctgagaatggaatgcgcctggcatgcagtacattttggcagagttgatgagctggccatcacagtctctgctcctcttcaaaggcagagagcacatgctgggaagtagctacccaactggggatgacacttcccaggccgtggatctgggcagatggctcagtcctggactcaaggcctcctcggggtgcttgctctgggctcctctaaagtatgcatgacgagccgtggtctcgaggttcaaaggacaccaggctaaaaagcgccttgtgatgtctcaagactgaacaccttgctgcgcatactggccacagaggtagagctccgatatcccaaacaagaagtcccatggcctaacactgcctggcacagaaaggatctgttttaaaaatgactgaaaatgtgtctgatgcctgggaaaccagaagcccgcccagggccaaactctggctccactcattatgtgactgtgggaaagtcagtgaacagtgtgcctcagtttcgtcatctgtaaaatggggataatgatgatccatacctcacagggctgtcatgagggtgcactgagctgattaacgcatgaaaagtacatggaggagggccggcacctcatgagggctttttccatctgtgctcttactgatgctgccataatatgtgtcactcatcttaagaacggtaaaggccaccctggctgtgtagatcttcagaaatctcctttcccgaaacggagggagggcacgttaaactctctctgtttggcttaccatggtctttcccattaaatacctctaagctctggcccctcctgtccttctcactgacaccaaagttgtttttctaaaaaacagtgagcatattaaataagtaaataaataaggaggcacgtgttctcaggacctcctgagggtgtgtcatggttaaagaaaaataaattttaattaaaaaaatgtgagttgcaaacccccacccccatgaatctgccatggctccctactgcccaagactaaaatcctactcctcagcctaagatcttaggccctcttcttttgactccatcctgcttttccacctcttctttcatcccagctctgcattccccctaggtactggcacatcacacgctactaacttcctaatatgccaccatgtgggcacagccaggcctctgtgtgtgtgcttcagctccccacctccctttgacacctgtggaaattctacacatccctcatgactcagctcaaataccacctcctccaggctgtcttccctgatccccagagttggatacattataaactctcaacaatgcttgctgaatgaataagtgagtaatgggattcctccgtcctcatgttcccatagtcagtgcttgaacccatatcattctatcccaggtgtaagtttcacataactctgctccacaagccatgagtgcaaaggttctcccccacctctcacctggatgttttgatgaactttcaagatgaagcaagagtccaaattcctagccctctttcaaagacaaatatcgacaagccagatccccatcttggaatgacgtcacaatgacaaaatcaaagatcactgactgttggcagtgcttactgaagccatctaggccccctggttttcaaacagtttttagcaacagaaatgaacaatgtcaaataattaacagactttttaaacatagaactgacctgcgcaaatagtgcttagatccgtgaggcacctctgcaaaattccagggctcatgggaacctttgaaactcactgacccaggcttcccctatgttttgtacacaaggatgctggactcccaagcaaggaaaagcctggaaggcacccagggctgtcctcagcctgcttcctgtctgcccccaaaacagcttgtgctccaagaacctggagctccccgcatttccccagatgtgtcctacatccgtgtccccaaaacggcctgtgctccaagaacctggagctccccgcatttccccagatgtgtcctatatccgtgtctccaaaacggcctgtgctccaagaacctggagctccccgcatttccccagatgtgtcctacatcccggccccccatccatcactccaccttccaaacttagtcaggcatcacttcctgcaggaaagcttccctcaagcctccaacctgcccttgcctgtgggtggtggtaggtcaaagccaaagccagcacccacaggatagcatctaaaccttacagcctaggtaggcagtacccaacctttaactgcaaaccagaggcacaatgtgaagagggcctgggagaattgcacctggatctgatttcagagtaaaacacaagccaaagatgggtcttatccagcagatacctgagtggcctctggttgtaatttaaagtcaacaacaccaggccgggcacagtggctcaagcctataatcccagcactttgggaggccaaggtgggcggatcgcttgaggctgggagttccagaccagcctagccaatatggcggaacaccacctctacaaatacaaaaattagtcgggtgtggtggtgcatgcctgtagccccagttactcgggaggctgaggcagaagaatcacttgaacgtgggaggcggcggttgcagtgagccgagatcgcaccactgcactccagcctggtgacagagtgagactccatctcaaagatgatagatagatagatagatagatagatagatagatagatagataacaacaacaacaaaacaaatcaagaaaatgtccaagtttccatgcataaggcccctcctggttctttccccggcattaggggccagaggatcgccccccaccccaccccgggacttccgaagccccctctcatctagtctcccaacgttctcccaggacacccgccctccagccgcaagaactgtcatcccccgcccctgtccccgtgtcatcattgtctgtctctgtgcctcccctctcccccgagtgggggctaatctctgtccccgcggtgtcccgcgccgcgagcgcaacaggagggggcgctggagcccagggcccttgcgcacccgaaggtttccgcagggccgcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggaagacctggaacgttccctcagctgggggaggccttccggaggagaagtctttgtccttggctggggtagagacagagagaagagacgcaagttggggacctgcaagtagggttccagtccaggtccgcgtgcgcaggccgggcgccctcaggtttagcggccacgcccttgcgttccttccgggttgcgtgaggattcctgaaacgcagttttcagcagctgctctgggcagctccacacgatcctttcagcgaagttggcgagtgtccgacccagacagaaaaaagcaaagccagactccaagcgctatcagccaggcgtgattctaagcacttttctgcgcattgtctctgagtccttagatcagtgctgttatgtcctgtattacaggtgaggaaagaggggcagggagcgtggctggtgctgtctaggatggggactgaagtccaggtggcctggctgcagtgcccctctagtcaccactgcactgtcccctgctgacccgtcacctgagtgccgttgtccaagggcctgagactgccgacagccagacagatgtgcacacacgcttacatgcacatactgttccagtctgaggcgtcaaactacaggggctggtccaagcctcaggacaaggacctgcagacgtagagatgcaaggtttggcacagagaacagggcgcctgccttggtgttgtcctgccctgcagccccatctaaggacagccaccaccagtacagggccatagggcagaaacacctggatccctggcaaaggctgacaagctggcatgagccagggcaggagggatggctgtcctcagctggtcagggaatacaggccaagtggacaggggccaggtgctccggaaggcaccttctttgccatcatttgacatatttgtgagtgtgtgtgtgtgtgtgtgtgtgtgtgtgtgtgttgtaggcgccaggccctgacaaagctgtgggggtgcaacagtgaagaagacatatggatccatggttcagggacccatatcagtcaaatcccgtctggaagggaatgcgggtctcttgatggccacttacctgctctgccagtctcgtttgtctcctctagtgccaccagccacgagatagagctttggggctttgagccaagtgatatcagctttacctccagggccagtcccctcagctgtaggagtctgagcaagtgacttgacttttctggggctcagcttgcccacctgtgaaatgggatcttaatagcagcactggccacatatgttgttgaggagcctgctgcagaggaggtgctccgtagaggctgctgatcacatgcgggggcaagagggaacatttataagccttggggatgggtgctgccaattgaaatgtagtaccagaatatttttctgcagtgagaggagcttgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgaccttagaggacacaaactcctccctggtctgcaccccatcagattgggagcacctggtgtgaagtgcccctgccagaggctggtgaagggcaggtgggggccatcttctcctgcctcagctgtgctccccggagccccctgcctgtgtggcccgcctgtgccctccacccgctccccactcactgcacgggcagagggtgcccactgaccgacggtgctgctgcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctccctgcctcaaagccccagatcccccagctacacgctgccaggctggggctgagcactgtcacacggctgccacccaggcctgccttccccacagcccgccagccatgcagaaaagctgtccgtagttacctttcttctccttccacctggcaccccactcctcaggtggtcacactccagcagtgccctccctggccctggaggcccggcgtggctggtgtcatctgtgaggggaactaggcccagttccttggaattcctattttgtttccttgccatgggtctcagtgacccagctgatggctcagtccagggaccccagactctgccaaggcatttc

SEQ ID NO: 318 - DNA, 48255 bp, Homo sapiens
gacattgaccagaaaaagtgtttattcatcaagtctttaaagatacaaaaacacgtgtcttctgtggagctctgagaacaggactccagcaaagcacttttcagccttgtggtcttcaagcatttccaagatctgtgacattggaaagaaaaaaaattaagacagatttgggtctccatgagcagagagtattctttcccttagttctgggtagcatagtgcccaaggaaacctaatcagtacagtgggaaaccaaatctattccaaatcattacccataagcaatcctatggactctctgaggtttgacagagtcagcggccctctccaataaatgtgtttttctataataatgtgcagtgtgagtaatttgatgtttttgacaaatatttacccagcgttttatgaaggagaaggtttggggggcaagctgaaggagctctgactgccttttggaggagtgtgagtggcttacctttgctgcaaggagcattgtactcagcaattgcaaactcatctgaaaaaaaaaaaaccaacaaaaaaccagaaatcattacatgaagtgagaaagaaagcaaacatctgtgggatacaggccaaggaaggagtttgttgtgggaagaacagtattgtaccagaaacataagcatcattcatctgatgtgttgcttgctaccttatattctcctttcaaatatagtgttttatatattcttttatcccaaactcctgaaggactcttcagatgttctacttacttaaatctcatattgtcatacagtccatttatctgatgaaaagggaactaaatatcccacaggtgttttgtattagtagttgataaatttataatgtaggttgtttctataatgtatgtataagagacaaaaagaggggcatcagacttgatggagacaaaatgaagtgataatgtaattacttaatgtaataaataaccccaacacatctcctaaacctgaatttctgtgatcaggaattaaatatttctacgtgaaaatcactctcactcacccgtctcgtagtaatcatagactttcactatggctggtttcagatctcttactgggacatcttgcagaaccgtgaagaacaagctcagtgtctgatttgacacctggaaagcaaaagtcaattaaatgacctttcaggaagctttcttctctctttgaattagtttaagtattcacctgttttttgggggaaaagctttattatcctacagcacactatagggtccttaattaaattgtgcagaaatctctcagaggggatgataaattctccagattatttcttaaataactaacataacgcatatacctctgtcaatgccaatacatagctctgttcatgggggtaaatgatatatactttttattggatgactaactgtgttcattttttaatatccagagatttggtatagtttgacttctctgtcttgcaggaatacttgcgtagactcaaagaggcatctaaaaggttgatcttcccaggcttaagtttcataaaatttgtaaactataattcccatcaacttatgcatgaacaaactctcctaccacacatatctataaaatcagattggtttactggtgaactggtcttattattttatggttcaagtccttgtggagactgacagttttttttccctttcatattgttgttgagtatgttgataattaactaataattgactaatcacaagggctacttccttatattactgggtatccaaaaaacttgtcaacataataaacacattttgtgaagatttcttgcttatgggattttaggaatattcatatcccaagatcataataagccatttctacctgtaatccctggtgaaatataaataaaggagagaagaacattcttttagagttaacattagaattctcaaatttctagcatggaagtgatgtttctaaaatgcatttaccttcccagatgttcccttagaggattattatctacgtttttttgcaaatagactggaagttctcttaccttatcaaggtaaatcaagacatggttgctgctgacttctgtccggctcacatggttagatctttcaagctgaagaaaattgaaataccacaaatgttaataaatagatgaaacccctgggggatccagagaaaaaatctttgtattgccaaaataaccctgagggtagaattcttcaaatgctttttgtaaggaaatatataatgtaatacaattaaaaatgaaaggcataaagggtttactattagtataacacacgactaatgtgtaaagttatttatctgaagaaaagacagctaagtatcctaaacttggtagttactcatatttcaaagttcaattcagtttctatttcttcataaggagtttttttcctgttttgcttgctctatttttcttttaacttctgtaatacttatagtttatgccaatcagtcattttcatatttttcactggttcgtgttcatatcttttatcttcttagcaaaattctaagctaagaagaaattgaaaagcaggaacctgctgacaatctttttcttgtagtcatgggtcctagcacagtgctctgcacatggtcagcattcatacaaacacatgtgattatatttctgagctggaaaaaggataaggctttgatagagattgactttaatagtattttgatattagtattgtcttatgctggggatacatacatcattaaataaaatagggcagtctggggttatgataaacctaccattttcactgttggcttcaggggaatgaagccagagaccatcttcacatcaacgatcgccatgttggaggcagagcggctccctgtgtaactgaggatccaggggaggaaaggattagggttttctgtgtttttaaatattttcttcttctatgtccatgttaagcattccacagctctaaaaggtacacgtaagtcttcccaaatatcttatcccagtggtttgtaaaagtggtgtgcgtagaatttttaggaagcctgttaaagccacagagaccaggccctactctagacctgatgaatcagaatgtctagtgtatgggggctgaggatctgcattttttttttttgatggagtttttcactcttcttgcccaggctggagtgcaatggcatgatttcggctcaccgcaacctccgcctcctgggttcaagtgattctcctgcctcagcctcccgagtagctgggattacaggcatgcaccaccacgtccgactaattttgtatttttagtacagacggggtttctccatgttggtcaggctggtcttgaactcccgacctaaggtaatctgcccgccttggcctcccaaagtgctgagattacaggcgtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtccccgagagtttgcatccgaaatttggactgcttaatttattttttggcatatatatacaccaaattaaatgaaaaaaatatatatatatatacttaacttttaggttcaggcgtacacatgcaggtttgttatataggtaaactcgtgtcatgggggtttggtgtacagattactttatcacttgggtactaaattttgcactgaattgttgtttttttctgatcttctccctcctcccatccttaaccctcaagtaggctctggtgtctgttgttctcctttttgtgtccatatgttctcatcatttagctcccacttacaaatgagaacatgcagtgtttggttttccattcctgtgctagtttgccaaggataatgacctccatctccatccatgttcctgcaaaggtcatgatctcattctttttgatgtgtgccagttatttgttacatgtattttgtcctaacttttttcctgaatagtatctccaaccaagtaataatatgtttgtggagagagagttttttatcagatctgcagctatttaaatattgatgcatataagtgtatcttccccccaaattaattatatcatatataacctgagatttattattgccagtaggaattctaactaaggagtcactacttccttctattcaaacttttcaataattcttcatctctatcttcaataaagcaagaataatataggatttcattacataacaaggaattcaggtcagaggcaatgggtaatatttacttagttgttattgagggaaattattaccctttaaacaatgaggttgcacaatagtagatcctggatggacaatgtaaaccccatcattgagaaattatatcaacttaagagaatacattgcattttttgtgaatagtgcaaatatctactgttgcactgctttacttaaagaggagttcccgaaagaagactggtggttattcttaggattaggtgatagagtcagaaggtcttacctgacacttagggagatttggaagctggtgtgggctttgggttcatcacaagtttgaggcagagtctgcactcctaaagcaaaggggaactcttccttttctgggagaatattgtatttcaaggatgtctatagaacatcaaagacaaaatcagttttttgccctttcccagaattcctgtccacgtccctaaccctttctctgatctgtcccattgttttctgagttaggacttctcagagagaacagctgctgtcctcatctgtcctgtcctcacctgcccaagagtctcacctggaggtagacacatccttctcctgtcactttcatgctgtattccccaggcagctctggcaatgagacctgctgcagtaacaggcggttgttgttgtccacttggaatttgctggaaaatgtccctgaagactggatagtcacctgtgcagccttcccagtcctggtaaatgtggctgctccatatttggacagagcatggagagccaccactgtgtcctgttagagacagatgagtgagagaacccattgggcattataaggctttgagggctgagatatttttcaaagacccatgtgagggactttgatttcctacttccctcactacttaaatataggagctgtaatttcaagattgattataatctttagatagttgaagaaccataacattcacatatctaccttggactgtatgccctacatgtttattttatttatcagaaaattgatccttttctctctgtaagtatatgtgggacatggaatgtggaaaacatgtgaatggcaatcagttattggcatcagctatttgctaacatgtctttcttgacaactatgctcatatctgccaccactcaagcaaagttcagtctggctctctcccatattaaactttgctcagttgctgaggtcagtgtcctggagagaacccaaggttctttgcagccatgagcagagtcatgcttcagtttctccaaaagaaataaaagatgagtattataattatcttctggatttaatgacatttttatttggctttccctttttattggatgatttcctgttcccagtgaatgtctgctggtatgtatcctcaacaacattaaacctgcttggcctccttcaaataatatgtttctaataaatgaatgataacctttaacaaaattacttagtttttttcattcatatgataaaagattaatacaatggaaataggatggaatgccattttgtcacattttttccgttttagggtatataagcaaacatccgaattctctgaagataaaactttctgctgtgtacatatcaatgaattgttcagatacatggttatatagctagatttaggaggttggatgaataaagacagttctttatgctcctgatgaataaatgtttgtgtattaagaggtgaatagggggctggacgcagtggctcacacctataatcctagcactttgtgaggccaaggcggatggattgcctgagctcaggacttcgagatcagcctgggcaacatggcaaaacctcgtctctactaaaaatacaaaaattagccaggcatgattgcacatgactgtaatcctagatacttgggaggctgaggcactagaatcgcttgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttgagtagagttcctttgaacagtttgaaagagaccctagagctttcaggagaatggcaggagacatctccttcattctgctggtgctccactgctgcttgaggaaggcagtgttgttatgggaaataggagatggataataacacagcgatggggtgccgggattctgagcatttccttttggccctctttgactttgatttgcttttatttccattatccttggatactgaaaacttttcctcatttcaagttactgtcatctgtatttttttcttcttggatgtgtttgtttctttttcattcaaatcttttgctacctgaaggtgaaataaaaggttttggcaaatcaccaacctgggtggaggagaaaccgccctgggcattctgctgcttcgtgatccacttcacgatgttggttgcagaggtcaggtcctccgaggttggggctggctgggccgtgagataagcgaggagcacataggatgtcatctccacctcagcagagggagcctggggttcgtaaaaatgccccactggtgccttgggtttctgagggcgctcccaatggacagagttgtcttaaagatgagaaaaagatatttataagtgcctacatatttatatttaattcaaggtgaaagtacccaagccagtgctgaaatgagaattgcatgcccattataatcccctgtactgtatgtagatgcttttcccttcatgtaaatctgaatttggtgtgttttagcccagctaaggcagatattgatgctggagtcagaagcctatgcctatctatgttttcaaatcgttgctatagtcgggttggtgggagaaagaaatggcacagcagttgtctcattgagtctggctatttcctatttatgatgttatattagactatagctggagtttgttacatttcctataaagtgtgtctttatcagtttcttgtgaggatcacagatcacatgaaatagtagagtttctactcattaaattgaaaaaaaaaatacagtaatccttgaaataccaaaggctgacatggatgtgaaacaatgggaaccaatatacactgctgtgggaagccaactgctctttggcaatattcagcaatggggaagatgtgcttagcccactaatcagtcattatgcttctcaaagcataatttggagaaacacagatgcacaagaaaacaggcacatgagtattcattgcagcattttttttaatagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacatgtgaagattctaaatattagttagggatacatatgcagcaaaaatataaggaaatccatggaattgtaacgacaaattcaggataatgattgcctctggaggtggtagtgatacacaagggatttatttttcccatgtcggtaattttctatttcttaatctatgagagagttgtacagtgttttctagttatagcttatgcccttttgtatatctattataaaatatttctcaatacattttaagaagaattaatggctgtcaaaggaaaaaggtagactgttttaatggacatcttgtgatttgcattttattttctatttcttcaaccgctcatatagaccatggtatatgtagaagtactgtgtgaatatgagtagattggtcaacattattggtcttatgaaatgggcttaaaataccagaattcattcaaggagttacttccatgattattttcttatgtttaaggttatataatgtaccaggtaagggttgggcatatattgagaactgatatgttaattgtaataactagtacttttataggatttgctatgtgacatgtactctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcaggatataaccccatcgtaattgagaagcatctgcacggcctcttgtcttctgatttctgatttgattaagaaatcctagattttataagatgcaatatggacaaaatatatatgatatatagaaaagaagagaggagacagggatcacaggaggtaggagtgagggatttttgccatgcagttcttgatacagaggatgggccaggagaaggatctcaggtgtgctctcacctttcttcacagcttcctcattaagtgacttgagtacttccttcctcttgtcctggttacctgccagggcaaaagcataggccagcagtgctttggtatatacatggctgccatggtccccttcttgtgctgtcttccaggctgactccaggcaaaacagggcattgcggacaacagggtgctgtgaaggcagaacaagaagggaactaagctatgtaaacaggcatattagcattcccaggcaaatacacggatcacagcacagaagtttttcaaacgcatttttccaacgattcctcattcttatcaatagatataatattatttttatctgttattctcacattcaaaagatacatctttaagattcttttttgagtggtggtggtaaatagcctaggggaattactgggaaaatttaaacctttcttaatgggctgaccaaattctctgtagatctgggaagcactggcattgcatagaaagaaagctgatgctttgcttttaataggatagtatttcagacagcaggtcagcagtttcattgcatccagaactctccttcagcagaggaatggggtggtacctacagtgactgtgagaggaatctccagaagggcgatggtgatataggcggagagggtcacttcatcttctactcctccctgtgaatacgagagagagatctgaataattcaacttctgagaatgctattgattagttctttctattctgctgtgtcatggaattcatccttacccatatccatccctatagggcaaagtatcacaatcaacttttgttctatcccctcttttttggtgccatccaggttttattttcctctgaggctttcccttagaatttttcacattatcacttcctatcctcatccttgcagatatcataatggacaaatcaaaactagctccagaatgattcacctttatggcattgttgagcagtgacccagagctcctgaaacagccattgtccttctgcctctgggagagccatatgagggcttgggtaatgtgtgcttcatcgatgaagatgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagagcttatctccttgattaatctttagtctgcctgattaatctgctagatgtagtatttccttgctaactctctctttgccacagggagtcttagtatatttaattttattttagttccgagatacatgtgcagaacgtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctgtcattgatgagcatttgggttagttccatgactttgttattgtaaatagtgccgcgataaacatacatgtgcatgtgtcattatagtagaatgatttatattcctttgggtatatacccagtaatgggattactaggtcaaatggtatttctggttctagatccttgaagaatcgccatactgtcttccacaatggttgaacaaatttacattcaagtaatttgaatgtacttatttttgttagttacttgagtaaggctttaaatctctcttatctttagagatttccttctgcagatgacagaatcttctcacatgcagctcttacatgcagtaaattttaatattgctttactttagggatttaaaaaaatgttttatattactgtttccttctcaattgtttcctcttattaatgaattcattccaagtcaagctgaatgacttagaatgtgacaatataagctgaagttaacatggtttatctggaagttatatatgttcactggcaatatcattttaaaactcatggttatggtagctactttagaaagaatagccatttcagaaagaaaaccttggtacattattaataggatccattttggaaacaagcctaacataacatgtatttggatatcaggttttcttctgattaccttgctaatcttggtggatttatctagtataacaaaccatcggtctgataatacatatctgatagtgttgctgtgaatataattgaggtaatacatgtaaaagagctggcacacaaaaagaagctcaaaaaattgttctttccttaccaggtgttgccctggttcctgccatatcgctccccaaaggtgctgtaggagccatcatagtgtttgtagttcaactgtctctggtaacctggaaaggaagattaacgaaacagcacaatggattaatgtgcatgctgagggtggagaaattactaaaagtaccttggcttctcttgtgacatttcttaaattttgttgtcatagattaggagtttctgagccttaaatattttattggaggttggagagtggatagtttccttgaaattaactatcatagcagctatcatagtgagctaagctaatgtatcataatattcataagtaactgaaacctactgggaaatccagttgaaataacattcaagttttcccttactcaagtaatcactcaccagtgttgagatagccaatggccttggacttgatctctggagtaagctgctgtgtttcatttagataatccagtacatagatgttaggagcaaagaggaccatattctgctctccacagccatagggcatctggagaagattttgtgtgttttgcatggcagagcctaatatgtctcctagagaatgggagagatgggaagtcataaagcttggagattatcatctatcaaagtcattaagcagaaataattagttgagcttagaaattgagaatttttaggaaggatgattcttccagggatagaagtatgattgaaagcaataaacaagcccaaagaagaagagaagaaagaagttaaaattatagtattatttttagtaaatatttatgggaaataaaaatagtataatagaagctgttaatgcccggatccactaggggctggagactcacccaaaactgagacagaagctcgggcagattcttctaccacatttggtggcagtttcagggataattcttcagaaacctcaccacctagagaaataagcaaatcagacatatgaaaattatttctgcattatatctttctaaacagctctatgacccagaagctaggactatgccttatacctaaactcctcctgaaaagttgtccgcctttaatacaacagtaatatataaatatcttaaaaatgggctactggtttcctgtgattttcagaatttcttcttcaatgatcttttcagtaatttatgtagaatcgcatgccaaataagacaacaaattgtaagagcctggtgatgttgtgattcagttgctgtcatctgatggctgacacaagacggttatcacaagatgatctatttagttcccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttacttccattttaatcttggtaaattatatgaaatgaaaatgagagaagtatggtatttattttcatactgaatcccttcctcataaaattcatattaaaatgtttcttaaaaaaaagccataagcatagttaaaggacaaatggctaagcaaaataaaatgcttgactcactgaaaataaaataactgctactgatgaacatacatttactacaattttagtattggtgaattatatacaaatgaaaaatgtagcagttatcttccctttctcataaaattaatgttaaaacttttgtaaaaaaacagatgccataaacaaagttaaaaaaatgaccaagtgaaagaaaatatctgcaacatattcaacagataaagaattagtgtcatacaactgagtcagaaaaaaactactcaaaagacaaatagccaaagattataaaggcaattaataaacatgcaaaaataaggtcatccttgtaattaagaaaatataaattaaaacaacagcaaaatttttttttctaaatttttggcaaaaattaaaattaaaaactttgatggtaacagatgatggcaaatataacactatggaaatgtatcctggtggaagtataaatgcatttaggtaataaagaggaggattttcgttttgtagttcaattaaaattcagaataaagcaagatgatggactagaaagtctcaggatcttcctccctccacagaaagtccaactagctgctatccacagatcagaaaatctattttgaaaaccccaatacttggaaacaagtctaggacacctacattgttcatagaactgagtgaagacaaattagaagagtaggaagaatggtctcactttgaccatgtcattgttcccactcctttaggttagcacaatgccagatagagaggagttccctggggtcacagtttctacagcggggaagagaaccaggggtagacatcaagattctcaagtattcaaagacacttctcaggaagcccactctggtctcatttcaccgggaacacaggaagtaatgaggtcaggtagaaacaaagaaggacagagctcacagtgaccagcatgtggattttggtagtgcttctgtgtttctgccagctatggcacccattcagagataccagccaactgcatagcccatctgcaaaactgagctggtcactttcagaagcatgttgggaagttcaacctagcttgagtttccagatggccagtctgtaagcccagcttcagaggttatgccagtgaccccacccaggtagcagacaccacctctgtgtatttcatagaagtgtaggggttaaatatgcttgacctgggagtctaaagggtagctcaactcagccaaaacctcactccatggctccattcacaagggtggggtagcaatcctctattatgcacatctaagaagtatagtatttatttctgcccatcccaagcaacaactctacctaacctcacagcccggattgtgaccctgcctaacttcaggtcccaaatagcagaatcatccagccaggcaacacatcttgtgactggcctgaccagaggccattgtagtacccagccagcagctccaccagatagcagagacaaaacagtgatcttgccagagagcaaggcccaaccagtggccctaccaaacataagagcaaaggcagtggcccagccaactagggaacccatgaaaactctgcctgctcaaggttgtcaccaactgatctttccagaattataggctagactaaatagcaaacctttatccctgccaaagaatacctataaaaaccagaagaagtggctttctcctcaaatgcacaaataatgcaaggacacaggattatgaagaatcaaggaatgatgacacctccaaaagaaactggccaagctcaaaaaattgacctcatagaaataaagatctatgaaatcactgacaaagaattcagaataatcctcttgaagaaattcagtggactacaagaatatataaatacaaaattaaatgaaatttgcaaaacaatacaccaacaaactgagaagtttgacatagaaacgattgtgaatagtgccacaataaacatatgtgtgcatgtgtctttatagcagcatgatttataatcctttgggtatatacccagtaatgggatggctgggtcaaatgtatttctagttctagatccctgaggaatcgccacattgacttccacagtggttgaactagtttatagtcccaccaacagtgtaaaagtgttcctatttctccacatcctctccagcacctgttgtttcctgggacatggatgaagctggaaaccatcattctcagcaaactattgcaaggacagaaaaacaaacaccgcatgttctcactcataggtgggaattgaacaatgagaacacttggacacaggaaggggaacatcacacaccggggcctgttgtggggtgaggggatgggggagggatagcattaggagatatagctaatgtaaatgacgagttaatgggtgcagcacaccaacatggcacatgtatacatatgtaataaacctgcacattgtgcacatgtaccctagaacttaaagtataaaaaaaaaagaaatagaaacaattatctgcaacttagctaatattgtaaaataaaaaataaatagaaacaatcaaaaagaaaccaaatagaaatcctggaaataaagaatacaatgactaaaattaaaaattcaaagtaagctcaacagcagacttgatcaagcagaagaatcagtgagctcaaagatagagtatttggaattatccaggcagaagagcagaaagacaaaagaatgaagaaagcctatggaaattatgggacatcatcatgaaatcaaacctttgcattaaagaaagtccagaagaagaagaaagagactataaagcacatttaaagcaataatgaaaaaaaagagtatagaatcagaaaaaaaaaaaagcagtaagggctgaaaacttccctaattaggggatagatgctagcatccaagtacaggaggcacagaggtctccagtgaaattcaaatgaaagaactgctcactaagacacaataattaaactatcaaaaatcaaagacaaaaaaaaattctgaaaagcagaaggtgataaagaaacatatcacatacaaaggaattccaatacaactatccatggatttttagcagtaacccggcaggctgagggagagtggaataatatattcaaagtactgaaggaaaacaaaaataaaaacaacatggaatcaagaattcttcatccagcaaagctgtctttcagaaatgagggagaaataaaacattcccagacaaactaaaagctaagggagtcgtcaacattaggcctgccttcaggaattactgaagggagttctttaagctgaaacaaaaggcccctaattaataatacaaaaacacaaaagcacaaaatttaatggtataagtaatatagagccatattcaaaatactctatgactgtaatgatggtatttaaagcaattttatctctagtacaagggttaaaagacaaaatattaataacaagcatagctaaaaataaattgtcaataaatacacattacaaaatatgtaaattctgacatcaacgacataaaatgtgtgtgggggagtgaaagaatgcaaagttaagttgttatcagcttgaaattgactgtaaaccccatagtaacagcaaggcaaaaatctttaatagaagcacagaacaaaaattttaaaagattcaaatcataccactacagaacatcagaccacaaaggaagacagcaaaagaggaacaaagaagcaaaacaaccagaaaacaacaaaatggtagtaccaagtcatttttaaattaataattaccttgaatgcaaatggactaaattccccatttaaaagacataaagtgactgaatggatttaaaaaaacaggaccgaaacatatgctaattacaagagactcacctaatttttaaggacacacatagactgaaagtgaagagaaggaaaaagatgttctaggtaaatggggactaaaagagagcaggggtagctatacttatattcaacaaaacagacttaaagtcaaaaactgtacaaagagacaaaggagaacattatataatgataaaagggtcaattcatcaaaaggatataacaattgtaaatctatacatatccaacattggagcacctaaatatataaaacaaatattaaaggttgaagggagagatatgttgcaatgcagtaatatcagggaatttcaacatctcacttttaaaaatggatagattatccagaaagaaaattaataagaaaacgttgaacttgaccaacactttagatcaaatagacctaatggatacatacagaacatttcatctcaagcacacaagaaacattctccaagatagatcatattttagcccacaaaacaagtcttagcaaatttaagaagactgaaatcgtttcatcgtatcaagtatcttttctgaccacaatactatgaaaactagaaatgagtaacaggaggaattagaaaaaattcacaaatatatgaaaattaaatgacatgctcctgaacagccaatgggtcaataaagaaatttaaaaggaaattcaaaaatatcttaagacaaatgaacatggaaatggagcataacaaaacatagcataaagtaaaagcaattctaagaggaaagcttataacaataaacaccaaaaaagaagaaaaatttccaataaagatactaatgatattcctcagagaagtaggaaaagaagaacaaagtaagctcaaaattggcagaagaaaggaaaataataaagattagagcagaaataaatcaaatagagactagaaaaagaatacaaaagatcaatgaaactgaattgtttttttaaaaagacagacaaaaacttttagctaggttagctaagaaaaaagagggaggccttaaatatataaaatcagaaatgaaagagaaattatggctgataccacagaaatacaaaggatcataagagactattatgcataagtatacaccaataaattggatgatctagaagaaatgaatgcattcctagacatatacatactaccaagactgaatcatgaagaaatagaaaatctgaactgacaaataatgagtaaagagattgaatcagtaataaaaagttttccattaaagaaaagcctaataactgttggcttcactgctaggttctacttatcatttaaaaagaatgaataccaatccttctcaaactctgccaaaagctggaagaggaaggaatactttcaagctcattttatgaggcaagcattaccctgataccaatgtcataaaaagacattacaaaaaagaattacagaccaatattcttgatgaatatagatgcaaaaatcctcaataaaatactagcatagcagctaagcatggtggcatacacctgtgggtggctgaggtggtaggattgcttgaactcaggagttcaagtccagcctggggaacacagcaaaagctcatcacttaaaaaactaaaccaaccaaccaaccacacgaaataaactagcagactaaatccaacaatacagtaaaaggatcatctacctagtcaagtgggatttatccctgagatgcaaaaattgttcaacatatgcatatcaataaatgtgatacattacatttacagaatgaagggtaaaaaccataccatcatcttgttagatggagaaaaagtatttgacagaattcaatgctcttttatgataaaactctcaccaaattagatatacaagcaatgttcctcaacacaataaagggcatgtatgataaacctatagcttacatatttaacagtggaaaattgaaagactttcctttaagatctggaacaagacaaggatacccactgccaccatttattttcaaagtagcactggaagtagcagcaagagcaatcaaacatgaaaaagaaatgaaaaatatccaaattgacaaggaagaagtaaaattttcactgttggtgatgacattatcttatatattggaagctcaaaagacttcaccaaagggctgcaagaacttataaatgaatgcaataaagttgcaagatacaaaattaacacataaaaatcagtagtattttctgttcactaacaatgaatgattgagaaagaaataaaaacaatcccatttacaatagctataaacaatatgtagaaataaatctaatcaaggaggtgaaatgtacagtgaaaattataaaacactgatgaaagaaatcaaagagaacacaaataaatgaaaaaaaatacaatgttcatggattggaagaattaatactgttaaaatgtccacactacccaaagcaatctacatattgaatgtaatccctaacaaattactgatgtctagttatggaatcataagtgtcatcaacagatgaacagataaagaaaatttggtatatacacatagaattccattccattttaaaaaacaagaacattctgctatttatggcagcatgattaaatctggaggagattatgttatgtgaaataagccaggtataggaaaacaaatattgcatgttctcatttgtatgtggaagctaaaacattcaaattcacaggagcagagagtagaatggtggttatggaggatgaagctggagtaaaaggaaggtggtgttcaagggacacaaagtctcagacagaaggaatacatttttttctttttgggatctattgcacagcatggtgaatatagttaataatagtgtattttatgtttcaaacttgcttagagaatttcaaatgttcccaccacaaaacataagtatttcaggttagcttgatttaattatttcacattttattcataaatcataacatcactttgtatgctgtatatatatacaattataaatggtcagtttacaatgtaattaaagaacaacaacaacaaccaaccaaacaaaactatgcatatctatgcatatgctctctgactcaggaatttaacattttggatctaccctagctgtacttgcatatgttcattaagaggctcttattataattaactaactaattttttaaagctagtgaatagttgaaaaaaccaatataggaagactaaaacactaagcagaattgtgatgtatttatattataggcttaaaagcaattccaaggaaagacctagatctacaatttaacataggtaaatctccaagacaggatgctgagtgaaaaacaaacagtgatttatagaatgaaacttatacagtttattatatgtaaatcacacatccacaaacatatacatctacacacattatttctaaagataaatggatggcaaagtactgaaaaatgttcaggggggtgacattaacctttaatgtgatgttctgtttttttttttaaagaagaatatatttttgtaaaattaggtaggcacatttgattatgttggtaattaaaatgaaatttagtaaaactatttgatgattagcccttacacttaagagatacatcaaaatgagtaactcagaaacggagaagtcatgataaaaggattgaatgataggtaatcagttcacttaaatgtagaaataaggctaaatgacaaggaagttatgtttttagggtacattttatgtgttacatcttggcaacagatgaatagataaagtatttagtacgaaaaacatactaaatttgtaggtagtcagagaaaggcaatgaacctatgtatgatgttgattcaatgttggtttggggtgagaatgcattgtgctgataaatttcttagtgtattaaatttttcctgtaagtttcttcagttccttctcaaatgtttgatagggcattaggtacgggataggcatcaaacagatattaatatgacaataatggtaaaggccatgacaacttttcctttgggaaatagcaatcccgttatcaaatactgttggctatgtaaaactcagtgttagaatgccctaaattcagccgtccatagtttgcattattaattatttaaggaaacatcccttttggtaatattaattttgattctacccactttctacctatgcccataccatacactggtcagaaagtcatttggtgtttgcacaggtgctgcaaaagatcaagactcagaatgcaggcctagggatattctgatcaaattacttggccttcctaagaactattttccacatttgtcaaatgcattgatggtgcttcaggtcttagatcacagagaaagtgtaggaataatatataaatgttctttgaactttaaatgttagactttaatgttttttaaattatgatggttgactcttacctgatggacaaagtagggagttgaatgttgtttccttctctagtccttcaggctttaggtaaaagaaagaaaagctagtgagaatggactgaccttcagaacatgtgttttaatggagggaccacagatatttggatagtgaagagaaggatttgaactgtattatctaagaaaattctgtacatataagcaatatacgtaggaggtagttcgatgcatgaacaaatgaaggaaaaattaagaaagtaaatcaaagggaggctgtgcatggtggctcacacctataatcccagcactttgggaagctgaggtgggcagatcacttgaggccaggagttcgagaccagcctggccaacgtggtgaaatcctgtctctactaaaaatacaaaaactagctgggcgtggtggtgcacacctgtaatcccagctactcaggaggctgaggcacgagaattgcttgaacccaggaggcggaggttgcagtgagcagagatcctgccactgcactccagcctggatgacagagcaagactctgcctcaaaaacaaaaacaaaaacccccaacaaaacagaaagtaaatcaagagagagataggacagagagatacatgagaataatattataaaatatccatatattattatattacccacatatattatatattattgtggactatatattatttaggtttacttacttcaaccaacagaggcttgatgactgtgtctttccttccgtgttcaggaactgaaggcacctcagtcccacacagctcttgagactctagtgcctctgcgctcacagtgaaattcacatttcctgaaaaaaaaggccagtagaaatgaatagcatcttccccttcctccatgcctccaaactcaagatttagaaatgttcaatgctctgtaaacttttgttttattaaaacacagaagcaggaacggaaacatgcaaatgagaggtgaatgatactgagaattcaaggtggagatgttgaggatatccttgtaggcatcttagaataaaaggcaaaggaaaaaaatcgcagcatctagtggtcttttcctgaaggaagtagcactcaatataaggttcccactgccatatacaatctttgagtagagaattatctctagcagttttttgctcacctaatgactttggggttactgcccaggacacagtttgccgcccgtttgcacagatgcagtgaggcgcttgttccttctccactgggacagctaggaaggcgggagaggcttccagctgcacactgacctgaaaccacacataagaaagggagtagagagggaaggagaacagagggagaatgggtttgaagtaaagcatcttgaggaattggttagatttcaggttgcctcacattaaagatgatataaatgaagatcaagtacctgaaatatatttaagtggatcttaatgtatcagatttacacaggtaaatctgagttattttggaagcaacctgctctttcacatgatgggaccagaggaagggaaaggtaatgatggcatgctgctctacctctttggtctggaactttgaccattcccccggatctcccggcagaggatacaagacttataaacagttatggtttcagcaaaggtaagatgctcacaaacgacttttaaaattaggtttaatataatgaatgagctacgaaaagttaaatatatgagatcgtagaggttgaaaccttgtagaatctgtcatgagaatagagtactgacttttgtcacccctgtcagaattcttcataccacacaaatactaactttgaagggttataagggctagaaacttgctttatggtgcaatttggtatttggagatctcaaaacctgtaacttttacaatcatgaatatctagtaagcatattttgcatacaagagtttgcagtattcctaggaatgcaacttttaatttacttgatggctaccttgtatttaatttaggaaagagatccttacccggatgcatttgggaaggtagtttaggaccgtggccttgagtgtgaaggcctctccacgaatcacagagtaaggcattgtgagctccacaaagaagggctggaaggctcggagagaggcagtggaagagataccaagtccagcatcttcagacaggcagaaggcccctgccttccactcggtgatggtgtcagggactgttactcctacctcagccacacctgctgagctggagaggagtgtaagtgaagaacagaaagtaagcagttaaatacatcctttctagggagagaatccctaggaatgattctactgccatgacttaaaaacactcaatagaaataccaataatggagagtataatcaaggattgagatgggaatataagtccttttcttccaactgtttttaattgtagtatatcagaattgtagcataatcttttacagacaatatagttataaatttaacatgcagtttgagattgttcttaagttctcttctctaaaatgctatttcactgagggctgctttataattttaaattctactactattgtgtatagtgggcctgactgaatctgtatttaactcaggattgctaaccagtgagggatctcttacaggcaatctgtgcagtccttggttgtattaggtccttatgcccattttctggaaatcttagaattaaatttgcacaaaattttttagctctgatgcaattagattagtaagacttcttagctgatgtatttatgttaaacatctcctgaaattagcaatgcgtttgaaagaagtacttcagtactgaaaaattagctaacagctcccagtttctccctggaagggcttcgtctacccactttatcagttgctgactgagtgttgggcttctaactagcctgcactgggaagcagaaggagcagggaaacgacagacttacaggaaggctgaaaagcagtaagggcacttcccatgcctccttcccctggctcgccccacggataaaaccaggtctgaacatacccctgggaataatttgtctatgcatcaagcaccccaatgtttacagctcgtacctaagggtctggctcctaaatcacctagctccaggagtagatggagctctgcaatcaggagtctccctagaccacagtgaacacagaggtggttttaaataggcctttgagcaatgccagtggctacccgcccccaccaccccttggctcaatacagagagaacaggcaaaatctcccatttctggctgtctcctaagggttgggcttctaaacagcctgcatctgggagtgaaagggagaagtaaacaagactccaggagcctgaaagggagtatatggccattccggctctttctctccacctgccccactggcttgtttcacggataaaactctgtttccagtgtctctctggaaggaatttgttcactccccttggtgcaaatgtacattgccacagccattatggaaaacagtatggagatacctcaaaaattttaaaatggaaactaccatatgtcccagaaatccctcttctgggtatactcccaaaggaaatgaaataagcaccttgtagagatatatgtgttttggtgttcattacagcattattcacagttgccaagatataaaaacaacctaagtgtctgggtgaatggataaataaattgtggctatgcgtaatggaatattattcagccttaagtggaagaagatcctgccacttgtgacaacatggatgaacctgggggagattatgctaagtgaaataagccagacacaggacaagtactgcgtgatcttacttgtatgtggatgctaaaagaagttgaatacataggaacagagagtagaaaggtggttggggttgcagggatgggaagaagcaggtcaaagggtacaaagttgaagttacgtaggatgaataaatttagaaatctaaagtacagcatgaggactgcagttgataatactgtattggatactgaaacttggctaagaggatagattttaggtgtgcttgctatgcacacaaaaataggtaacaatgtgagctaatggatgtgttaatttgcttgactgtagtaatcatttcactatgtgtatgtgtatatatatatatcaaaacatcatgttgtacatcataaacatataaaacaataaaaacagaaaaactagcaaagagttgaaaatagtcagggacctctattgttgcatattgcatatgcaggaagttacttactttaccaccaccaaatcccagatccatgtctcagggaagtactttcgtacggtctccgtgtgaggctcttcaacatgcaccaggcgtgcatggcctcttcccattacatctgactctatggtgagtgaggaagaagacattacaataaacatacagataaagcttatgagagaatgtaatagttgccaccaaaaaaaaaaaacaaaaaacaaatcgtctgatgaaatagagaggaaggaggagagggcgcttgggtcatcaaggaaagcttctttgaggaggaaatatgttggttgacttaacaagccaggagaggccgggcgcggtggctcatgcctgtaatcccagcactttgagaggccgaggccgagacggcgccactgcactccagcctgggcgacctgagcgacagagtgagacttcgtctcaaacaaacaaacaaacaaacaaacaacaaaaaaaaacaagaataagctaggagtgagctgggggaggagggtcataagcagaggctatagagactttggcagacagaggcttggattgtctgtggggcacaaggactctgtggagtcctatgtggctgctgccgctgtgctaagtggagagtgttatgacacaaggccgtgaagaggggcaggaatccaagtttccattggtgtgctcctctgcaggagcaaggaaaaactgacacacatgttatgacagtggctttgagaaacagtttacaggagggaaaagtttaataataataaagactttttattctctatcgtgtcagaagattacagttagtttccttcactctattcaccttctattaagggtgtgctggtcaatatttcacaaccagctctctggaaaaaaaaattgtgcatatatatatatatatatatatatatatatatatacctatacatgcataaatttactatatatcttactgataaaggattatacaatataatttataaataataaaatatgcggtaggcttcatagtgaattccatagagccaactgattctccttaaatgctttccttgatttttgaccctcttttctctgtactcaacttatcctcaatcatgatttgacaatatgggactataaataaatgcttgattactattcagttcatcaaagaagtagctcatgtcattgatgaatgtgtgtggttccaacataaatattggctgatgttttggggaagttgaacagcttttttacctgactgatggagaatgtagtgttgttgtgtgaacatttctatttctgtttacactaatcctacgcttggaaactttctctttcctttcagcctaacacatgtacctccatttactagaatttgagtttatattactatatgaccttgagcaataaccttaatatgtatgactcacatgtcctttttgtttgttaatttttgtcacattgtatcttttaaaaaatttaaaatttggtgaatatattaggcaatatatatttattaattttttgtttaccataaaaacctacacgtagaccttcaggtccatgcatttcatactgttgaagctgtggacacattttgggtttacgaatctttgagttggtgaatgcctttaagcccatgtcctgcaaagaaaattatcatctaatcagtaaatatatattataaaatatacataggtagctacttctttttattgaatttgacaagcaatccagttaacttaaattaaacttttaacattcacatctgtagaagggatatttatatacttaaggatgtaattttattcttttcattaaactctttcaacagtaattattttgtatatgtgattttaataaacatcacagagcaattaattcctgtgaaaaaagaaaacttgaataatactccaaaaagttccagcttagttcagcagcttttcgcagatctgctgctattagtagagaagccacttacctctttatatcccattaccctcaactaggacatgaaggcattcaaatacagactcttttccatgtgtaatattttaagaagcttaagatcagaccatctgcaacataaggagtttacctctaggaagctgtacatatccttttcatttgtacttgatactggagtatatgtgattccattaatatagacattatgacgattgatgcagtcttcattgtcctggtcattcaaaggcccagggaagccagtgaggtccttttctggtagcaggttgtaaacctgtacaaatacgaaagacaaaaaggcaaacttatttgtgacttttttttttttttttttttttttttttgagacggagtctcgctctgtcgcccaggccggaccgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttgtgacattttttaagttcaaggagaaaagaacaggaataatgaacatccgtctttctttgagcgctctcattgctttgatgatttatagagggtatggatcattttcttgacacagtgttttcattttgaagatgtttaacaattttaggaaaaaccaaacactccatctaagtactcatctaagtactaagtactacttcgttacacagttcagaggccaccactagactcaacactggaatgaaataaaactttattaattgaaaaatcgaggtctgctgtatttgtgacattgcacaaagctttgagatgatagaaggaaatgatagttttgtgcttatcttgtggtgagcaactgactcagtatatagcaaagttaatgggtgcatgttctaaacaggcacacgaataggaatatcctctctccacaggacacgatggcattttcttaggtattattagtggaaacaaaatgctccagatcttcatataatacatacaactttaaccgtaaaattctaggcatgatgctttcaagtccatttgaaggtgagaagtaagacagacataaaaattgtgatagttacattgcattatattcgtaggagtttaaaactgattgacaagaacagatgagcaaagtgagtggtgtgatgaaattagacactttctcaaagtatcttaacatttctcatttcctctccctgcttttattgtggcatattgcataattattgtctgtctcatctatgggacagacaatgtaagttccatgagacatacatttttatctttccagtagctcactgcttgatctctactagcacttagtataatacctagaacacagtgggcattaaataaatgtgttgaatgaatgacctacactagtagcagcaaagtgtttcattggtaagacactaatcaaagcttgagaagagttggtgttttaactcaggtctactactaaatccctgaaagcttctgctttattattaataaataggactgtctgccttatctacccatcagggttgttataatttgaaaaattctttgagaattataaaattatattataaaagtataaaacatgtatattattttcccacatatcctcttgagatcctactgttgaaatgtacttgatgcttcctttagaagtattctaatattttcagttaaaatcccattagaaggacaaacaagtaagaaacatttttttataagtttctatttcaggaaaataaaaatataaatttctctttgttaaattatggtagtagaaaaagcttcagtaagaggttattacaattggtctcatattaaaaatttgaagatgtgagcaaactactattagtacatgctattaactagtttttgttgttccaattcagcatatccttttggtatttcttctattagctccatattttcaaagagttcagttatcaatgtcaattatatagtagttcaatttccctaagttttgttcctcagagataatacatatgttccctcagaaattatgtgtagcttgggacagcaattatttcaactgatgtaattctttttttttttttttttttgacaccaagtcttgctctattgcccaggctggagtgcagtggcacgatctcggctcactcaacctctgcctcctgggttcaagtgattctcctgcctcagcctcctgagtagctgggatgacaggcgcccgccaccacgtctgactaatttttgtatttttagtagatacggggtttcattatattggccagactggtctcaaactcctgatctcaagttatctgcctgccttggcctcccagtgttgggattacaggcgtgagccaccaggcccagccataattcttataaaaacggaaatctgatatttcatttagcctgtatagcctcagtgcaggtatatgtatcacttttgttaggctttttgaaatgttgaaactagtttgacaactcctattactggttgcatggagctctgggattttaaggactttgggtactgtatggtctttttacattttaaatatataattttcgaacggcttccccggttgctcagttaatcctttcttttattttgcataactgcacttctcatatagcacttttcacaatctgctctgtattctctccagccttgcatatacggatgtcctgacacaatcagaagatttgaatttgtattgctatgtgctcttgagcaagaagcttaacgtgtctgaataacgagtccttttttggttgttaattttcatcacattttgtccttttaaaaattcttttatttgattcaatatattgtattttgtttatttttttaactgcagaagtgagtagttatatatatatatatatataattccttaccaatgaaagcccacaagagagctcaaagcaattaattcctagataaatataattttaattgatcttatcctacttatccagtcatttttccttgctctgagcccctggcacggcccttcttgattcctgaggctgccaggaactcaccgaggacgccgagagctcagcatcaggcttcatgagcagcacgctttggtccacagcacggagggcgcagacggactgaggagccgctgtgactcgcaggtgggcgtgtgaggctgggagactttgtgatgggctgaagctcaaatccacctgtgaaattggaacaaaaggtcagaaaagcaaatttccaggtttacccatgcattcactcgcatttgcagagtgttcctcatgtacaatgtataaccactctgcttgacttcgtggagggttggcattgtgtcaatcctgaagctttttgttccctacacttctctttcattctcaagaatcacttgagccagtagaattatttctaattattcttataaattactagtcatgaaatgccatttttatctttgatacacggcaaggtgctcattaattgtggtgggacatgcatgggtctaggtgctcttgcatttttcttttggctccttagtagtcttaaaaacttgcttacatatttcccaacgtttcatcatagaagaagggaataacatactctgaactgtgtaattggtaagaggcactgctaggagaagtttgagagttttgtataaggaatcaagtgattctgcttcttagtgtgactctgccactaccttgctgaatgtctctggggaatttgtttaacccttttggccctaatgttcacatgtgtaaaacaaatgataacaatagtaacttctagttttacatgttgaagattttatgatctaaaacacacaccttgttggccagacaattttcaacatcatattttgcagaatccccaatcacgtccccggtaggtaaaacagcatagatgagcaaccgagcgacaggagcaatgtctgacttcacagggattgagatggaaaaatggcccttcactggggcacaaagagaatgagaggaagccatcataggttaatgactatttccattagtagatgtaacagacataataaacagtagatgtaacaaatggatgattacctctaaggactctagctttagaaaaaaaccctatcaaagccctctctcctctcataaatcatatactctgttgatttttcaccagctttaagcttcagctcacccacctaatgttctgatgctagttaagggtatgaagacatccaattcactaccatttgatctaggcctcatactagaagagggaaatagaacctgaagttatgagatgtaagagtaagagttcaacacattgtattcatgctacatgctctttaaccttctatgagccaatatttggttctttctccataagaggaacaccatgctccttcagaagttattttttgatgcctatgtagattctttagaggttgcattaagtttccttcagtctgctatggtgcttctgtgttgctacaagaactaatgagagagtagattactgatacttttctagcaagttatcttttagagtctactagactaggagcaaccttcaaaggtttatattatgacatatttgctcatggcaagagtccgcttcagtcggtagaagtacccaatttaatgcttcataaatcataactatcttgaaagggaaaaaagatatttataataatataaatgacataaatgactcagcacaagacctggtatatacaacataccttgaaatcgtacattttctccaccccattctctaacacaattctcattttgagaagaggttcaagaatatttatggtttaaaaatctggaataagcatagattatacacaacaatattttatgtattttatttttccccctttgttcttatttatttatttatttatttatttacttttatagagatggggtctcactatgttgaccaggctggtctcaaactcctgacctcaagagatcctcccatcccgttctcccaaagtactgggattacaggcgtaagccatcatagctggcccacaccaatattttaaataacgcaaagaaaataggctgaaaaaaaagacaacacatatttgataaagggtgagaaaaaaaccattattgttttccctccctcaactttcttttaattaatattagatggaaatggtctctcgttacttgaaagtattcctgatattcccagctcaggaatggaaaaccaaacatcatatcttctcactcagaagtaggagctaagctattaggaagtggcagctaagctattaggaagtgggagctaagttatgaggatgcaaaggcataagaatgatacaatggactttgtggattcagggggaagggtggaagggggtgagggataaaagactgcaaattgggtacaatgtatactgctcgggtgatgggtgcaccaaaatctcggaaatcactaccaaagaatttattcattcatgtgaccaaacaccacctgttcccccaaaaacctatggaaaaaaagggaaagtattctgatacttccgtggtgtaaggctgaatgggtcagaatggggcagcaatgcagagatgatggaaatactcactgtcttcctgcttcacaagcagtccatgagtcccagttcggacaatgcctccctttgccattatctgcaaaaaaggaaataaaaagaaattaaatgtgccagagagaacacgcttcagtctcacttcaatatacttgttttattgagtccctgccggcaataattcacctcaagagaaatcaaactttcaaaaggaacatggataagaagttgaagtaatgacatctaaagagcttcatgattacttgctccacagagagcttttgtctacagtgaagtcaacgcagtaacctcccttctcaccagataatagaaggagagcttcttcagccccagcagggtgcctccattcagaatataatgtgcctggactgtctgagtatggccacagggtagttcatgagacatgggctcaaggtggacaaagctcttgcttggggagaacacaagataagcagtgtgatgtgcctcttcgtgttcttctgacacccactggtagccgtaacagggactacgatccttgtaattgacctaatgaattagaaaaattatattatttttagattatacgtcataaagattaatgttctcacaaaactacgtaagtttactgtcctaccttaactagtagctagaaatcttttgttccacaatgaaaagtgggagaaggacccctgattttgtttctctgcttcaaatgtaggcatgctttgtgactttacactgcagagcctcctgggattgagatttatatttcttaagagcataaaaggaggcatcctttgctctgattagcttgcttgaaatttctttgactgctttacctgtgcaattagagacactggagctatgaaacttcattgaggagagtaaataatctctagaaatggaagaactgtgctttcagaaagcagctgcctcttttagggtggattttgaatgggtattatgaataaataaaatattgtaaccttaggggtctgagaagacattggtagaaagcattggtttaagagctgagctgatgaattagctgaagtctacctcttctgggctatcttaggctgattgctattattattatttttttgagacagggttttgctctggcgcccatgctggagtacagtggcacaatcttggctcagtgcaatctctgcctctggggctcaagtgatcctcccagtcagcctcctgagttgctaggactacaggtgcatgccaccccacccagctaattttttgtatattttgtagagacagggtttcaccacgttgcctaggctcgtctcgatctcctggcctcacgcaatccacccacctcagcctcccaaagtgctgggattacaggcgtgagctaccgtgcctggcctaggctgactatttttaatgctccctgcaatctggattctaatacctcagaggccctatttgggttatatttccaacttttcttcctgtagaagttattccttagctcctttcaggcttcctctaccttcatccccagctcccaatagcactagtgaatccttgagcaaaacattttgttcatatcttaatgtatattttggtgacaacacatatatgatcaccccaaacagggaacaggtagaaataataatttcattgtcaagactagcacagtgctggcacgtggaaagcattcaagacactttttgaaatgagtaaacattcaaattagagggaggtgcttttatgccatctattaaagctaaataaataaaatgtattatttatttctctataacaaggtaaaactctaaagaggcaggcgttttccattaccatgattatgtaatatatattaaatatgtattgtatatccatgtatctatagacatgtctacatctctcttgatgaatagaggactgcatgctataccgaataacttatattggtatgaacaggtcatctggagaaaattagaatagcaagacaaaataaagtaaggtaataatttttggagtatatatatttaaaactaaatgctaattatgttagaattggcttttatagtaaaagtatctaacagttaaagggggcttactaagtgattcaacatgtatgatttcacttaatcttcacaaccaccccaagagtcaggtgttagtattgcaatcattttacagataaggaaatgaagcacagaggttttagttaattccttaaaatagggttgagccagtatttttaaccactttatctgattcagattctggaattcacacttttcaaaaaagttattataaacacacacacacacacaacataaaattaccatcttcattattctttagtgtacagtttggtagtattaagtatatctgttgtgcaacagatctccagaacttttcatcttgtaaaactaaacctgaataccaataagaggaattccccatttctctctttccctagcccttggcaaccaccatcctgttttctgtttctatgactttgactactttagaaaccccatgtacgtgaatcatacagtattggtctttttgtgactagcttatttcacttaccataacgtcctcaaggatcattcatgctgtagcatgtgacaggattttcttcccttctcaggctgcataatattctgttgtatttatataccacattttgtttacctgttcatcccttgatggacatttgggtagcctcgatctctcagctattgtgaatagtgcggctatgaacacgggtgtgcaaatagctctttgagaccccgttttcgattcttttgaatatatgtccagaagtaggattactggatcatttggtaattctattttttaattttttcaggaactactatactgtttttcatagtggctccgccattttacgttcccagcaacactgctaaagtctaacccgcacttttaatcacaatatactgccttcttttcataaactttaaaaaagttaaccttcaatcggtttctaattgctagtttttttctctccatagaactagacacagtttggaaattttctcacccttaggttgcaaccttgtttccaaggctacttcatgtcattggtaatttctttccaaacttaccctaacagtaagagaggtacccataacattggtggtgttgatagagaactgtacaaggccatgctcatccgtggtagcattggagtaatagtttgcttcatttcctctgatgaatatgactttatttggtatagggacgcctttcccatctactaggcgcacctgaagattaaaagctgtggattagttatattggtaataactaataggcaccaaacatattcatttatcacattttttagtgcctcctctatgttgaacatggttccaggcactgaggacacagcagtgaaaaaaaacgaagtttcttccatcacagagcttactgtctagtgaaagagatagatgctaaataaatatatacataacatacactaatttagtagtaatcaatcctaagaagaaaaacagagcagtgtgaagggatagagagtgatagggataataacaagagtgacctgaaaaatgtcttctagatattttggaagtgctgtgtattattatatataactcttagagagtcacagagcactagagtaatatgataatgaaatattttaatctattaatctattaactaaatttatttgtgccccaaacacctattttggagtggaccattaacttcctatagattagtgtctgaagtctcataagtgcacaagtaaacaattgccaatacattgtcctgtgtgtttctccagttgccttagacatggtctctgcttctcaacctagatcttcagccttttggaaggtaggcagattttatgacacacttcccatgtgaaaaatataaaattgaaaagaggcacacagtattaaataagttgccaaatctaatttactgctaatattgtattggcagttgagtagtccagttcagattgtaaaggtggcaattctttttcagtataagctacagttggtagcaggaagaacaataggctgacccccatcagtactcataattgatttacaaaatctaagtttgccagtgaaatgttggctgcatgtacaaagacaagaataggcacataattctgattttcttctagctagagagtcttatgacaaataggatatttaacagcaataaaatgtacttacaaagtacactatctttctgagaaatttacaaatgagctacactttcattttaggaagttgaatacattttggtgtcatgacataaccaagccttctagaatgtactccactttgttgagtctatgcctcttttacacccttcatagctgaaatcctgtaacatttacattaagaaaatgatacacagtaaatacacattgaggcacatgtaactgtgatctcagacttctagagtcataaagatccatttgcacatctgctgacaacagaaaaattgtaagagaagatttttttggtagataacatgaaaattcataattcaaaaatctgagaaccttaaatagcagtgttttaccccatgttcactgttttagaaatatacttgttatagaaaaatagtgtaaatatactatccatgaaataaacattattgtagaatctttaatacttcaaaataaaaattaaaaccacctacccacctgtttccatacaaagttagtgttagcatcgtaatgaaactggtcagcatgaattttgagattcttgtgagaaaatgtcataaaaacctgagactgcctggtaaaccatgagaaggagattgagtgacttgtacaatgctgtttcaaaagaaggggggaaaactctactaattttaataaggccttaggataattacatacatttcatacacaaatttacagaagaataaatctatttttatgtagttttatacctttggttatactaatcaagccttggtgatattttatacttttggttatattaaatgataacattaaccaggcatggttttagcacaaaccataactattgtgctaattaggtaacagtacatgggttgatgagtgaactggaaaatactccacctgcccaaagaagggaattccctgtcgaaagtgtgagtccactttcacaaatgagagtttggttatggttcttgtgatttcactggactgccttccagtcaattccaccactgaaaaaagagaaaaaaatctgttatttttgggaagaatgatgtctctaaaattctatcacctccccccaacttacaattcattatttggctaagaaaatcaatgcctgttgtgttttctcttatacccatgtagtacacaaacctgttccttcttcttggatctgggcctcagtgtgaagtttcatttcatactccttcctcttcagctggaagaccttggtttttacttgctgatagaagcagccatggctgtttagctaagaagggagaaaataaaatacaaaaatataatgcatattatactaaatagatcagtggtcagataaccggtgtgatttttgtggggggacaacatcatgtaggcattttctatgacgaggacacaataaatattctctagcaactaaatattaaatttcacaacaatatctcatgtataattgacagatgtattccttggtatctgaaattccctagatatattgcgatagaaatgtcttaaaatttgaggagtaattttttttgtacaaaggatgcataatatttatacatatttatggggtacacgagatattttgttacatgcagagaatgtgtaatgatcacatcgcgggatttagggtgcctaccaactcaagtatgtatcatttctatgtgttggaaatagttcaagtcctgtccacttgctattttgaaatacacagtacatctgctcttgaccattagaactcctcatcaaagtctggttcctcctccataatattcagctgtggctgggaagcggccttctatatggggactgtgtttgtcaactctctggcatcttggtggggccatgtgataggttcttgttcacagagagagcagaactgatggcctggccagctaaggcaattaagaggtgtatggttttttccttcctttgtagaagtgaatgcccatggaggctttagatggctcagtgtctatcgttctgaaacactcacaatgggcaattacgagaaataaataattcccattgtgctaagttcatgattttttttgaaaaattacaatagccaacatggaattctcttctagattgttctcttcctgcgtcagaaaaatgctgcaactcactgcttttcaacaatgcctttatcgctattctctagaaaaaatagtgttcaacctacctgtccactgaatttctcacagaaagcctgtgaatcttcaccgtggcagtcggaagcgtcactatactttctgcaaatgctcacagtcacatgtccagggacaggcttcccatatgtgtatctgtcatgagaacattcccaaaggaatcagagcagacactgaacctccccattttctagctatttatatctcccctttagctacagtatattccctgtctgtacttccctctgctctctgctgggctcacacaatattgaagacaagagtcactaatggctcttatagaaatctccattgcaacatgctgaaatttacattcttcttttatcatttcttttttttcctcgtttttttttagttttatcttaaaaaagtctttcttattataaaacttaaacccgttcttaaaagagaaacaataccagcaagacgaaacaaacaaaacaaaacagaacaaaaaaaacccaaacgccctcaagtctacctaggaatacaaactattagtacgatagtgtctcttcttccatcatcctctccccatgtgcagccatctctatatcgagtttcacttgtttattttattttattttattttattttattttattttatttttgagatggagtctcgctctgtcgcccaggctggagtgcagtggtgcgatcttggctcactgcaacctccacctcctgggttcatgccattctcctgcctcagcttcccaagtagctgggactacaggcgctggccaccatgcctggctaattttttgtattttttagtagagacggggtttcaccatgttagccaggatggtcttgatctcctgacctcgtgatctgcccacctcagcctcccaaagtgctgggattacaggcgtgagccaccacgccgggcctgtttacttttttacaaaagtgggattgtgtcgtaaatatgtcatagacaattgctgggtttccaagtgcatttgtctcctttcctatttgagaatgtcctctgtatgtctatttgcaagatcacaccagttatgaggaaccaggaacttggccatcactgtgagacagaactggagcaggggcctagctgaatagtaggtgtattacatgtgtgatctttggacaggactatacctgctcttcctgctactgctactgtgtgccaccatggatgggaacataagatccaggaaacaagacttttcaaggttggaacagactgtcttgagaaatcacgttcagtctcttcgtaaaaatgtcagtgcagacaggtatgtagacccgccttaggtggactagtgagttagatgagatttcagttgtatgcctatctctacaaattctgaatctaagtgatttttccagtaagcatgcaaggtcaggtaaatgatctgttgatgattgaatttcccctatagccatgtgttaattatctccctaatatacgtttggttatttttggttaaggcagaaccaatacccttcaacactatccacccttcccattttgtgtgtgtgtgtgtgtgcagttttgtcactttcagaatcaatcctattagcataacctctctagaaacagtttcttacctcatgatagaataatactgataagaacgtgaaagaaaataaaaatagaaaagcaacaggagaataacattctacagatgaggatgctgtcaaagcacttaaaatttttgtgttgccactgctcccggagagagtagttaaaatatcccaaatggtgagtctcttttaaataatcccccacaaaagatttttaaaaaatgaactcacaggccacacactgatacattcatctcttcttccaagatggtgattatctttggcactgttacttgtacttcaaacttgggaagaactgttgattggtgataaagaaggttggtgattggttttcaactttgggggaattcctattttcaggttccctgtaacagttccctaataatattttagggctctgaaaaggtagctctgctctccaatctattcttatctatcctcctctcaaatgaagatttcagttgagggactatgagagatcactgtgtgcttaattaattatggaaaactccattaaaacaagaatgttttaattttgggggttggtattaaatattgctacagaaaataacgaagctatgtgaagtcctattcacagatcactgatgtcctcattggacttaggtgtaattaattctactccaagcccaatgtcacccatgggaaatggaaagactccaaatgaacttaaattccaggacctaagagtttaaatatgaagaaaaataatgcttgatgacttttcatgatccataccaaattcctccacggtgaaagggtgctctgtccttccacctgatttcttctgtaccaccaccttgtaggagccctggaagggctctgatgagaggggaaaagaaaattgcttgaggccaccctctaactggaaactctgccattgtgcgatgcgatttcctttgggatcctatatgagtaaattaattataacttacaaaagcacctggagcattggagctaataaaagatatctatggaaaccctaagttatctacaaaaaggtcaaatggggtagtagtaaagggtgagtagaggagatgagttatagccatctagctctatgggagtttgaaggcttctcctttaatgacaagtttctgagatattgtaaaaacctctgaaataagaacattttccctatatgtattgctttccttttaatatggaatgtttcatgttgcttacctgaatgtatactagtggaatctgaaagacaaaagaaaaaagaagtttataattattttcaaatattcttaaatctcatttataagcaaagcagctagtatttgctagcataacagggtgagtatagtaaaaaataatttaattgtacatttaaaaataactaaaagtataattggatttgttcgtaacacaaagaataaatgtttgaggggatgggtactccatttattgatacaggcatgcaatgcatgataataatcattatccatgattggataatgatatggataatgataatgattatcatccataatcattatcatgcactgcatgcctgtatcaaaatatctcatgtaacccataaatatatatacctgctatgtttccacaaaaattaaaaacaataaaaagtttaaaaaatctaaattagtttcatatagaataattccctctatagtgaaatacagaaatattccagattaaattttatagaacttttcattaatctattttaagcaattaataaataatgttaagaacttactaggccttcagcaacaaatatacatgtaaagtgccatttactaaaaatggattaacatgtcttaagtgcttatagcatcctagtgaagatcaatcctttgctatgcaattttacaggttgagaaataaacacttatgtaactataagtaaatatgttcagatgtaatcattaagatgggtcatagaattcttacgtagttctaagaatgaggaggaatggacatatttcattaataaatttagtttaataaatattacttttaaaaatgaataaacattgataagaagctactatgaatgtttattcatttttaaaaactaatctttattaagtaccttctcatgcgctgtgtatcattctaggtattgagaatataaccacgcacaaaagaacaataaaccatgttttaatggagcttatgttataatagaaataggcagatttttaaaaatcaatacgtatagaatggtggtaagtgcaaatagaaaaacaaagccaagttaggctgacagagtgatgggtgtggtgcctcattttagacagaggagtgaaagtagaagctgggagaccactttgaaggttattgtaatgatcttatttagagatgacattgactaggactagcttgcagcagtagttcagatgataagaaatagtctgaatatattttaagccaacatgattttccagtgaagtggatgtgggtatgagagaaagagaaacaagaactaggccataatcttttgtctttggagctagaagagaagagttgcctctttttgagataagaaaatgtgaagaagttaatttgggagagaaaaatgaagactttgggttgatgtctgcattacaatagaaagaactgtttcttatcacagataccaagagttagtcttgaggaacaaattaattaccctgactttcctttatagtgaagattttggtagatgtgtatagaaaaaatctaaatctttaaaatgttttttgagcttaggttctttgaggatttttctgtgtctgctattgaatgtatctttctaattgtcctaattaagaaccatccgaaaagtaaatttaattgtgtgacaactgactgagtaccagcaccaagacagaaagaattacctactttctttacctggaatgatgttttagattaggatcttgtgctgttgtaatgccagaagttactgttaatgataccagattcttcctctccctggtcttccctcagcacaaaaaacaggttcccagcctgtttatacagacaatcattttatgtagataatagaaaactcaccaactcattcagggggtgaaagttttcatccatggagacaacacgaaatttcactgaaacagaaatatttttcatgagcccccaaacccaaagtaggcctgtaggctggtaagacaagctattaaggaaccaagattataggaactttgcctggggaacatccaggggaagaagatctttcctttttgaagttgtcctgtctgtaggcttcttcatacctgtctgccctggtttgtagattgatttgtctgtctggacaaagaccagactgtcctcgttcttaaccatcactgtggtccgcttcttaaattcttgggttggtcctttcacttggacagtgaggaacattacctcctcattggatgaagactttgggacctgaaatacaggaccgatcctgaaaccccattcagcacccgcaggtctcctcccctatttgctgttgcactcttccctggagatcttgcccttcttacttaacttcactcccttgttctcagcagggaaagttggcatggacaggaatcacttctgccattttacaaatggggagacaggacacaaggtggaggaaaataaatcagtaagagaggttgtaagtgagattcacaccttcatacagctcacagaaacagtcttgattcaattatacgctgagctttaccaggctgatattacatgctaaaagggcatggtcgaagcatgttttacaggctatggaaaaaaaccccgtattttactgacactaggctgtaagcatctcacatgtggacaactctgaagagatattacacctttgctcagggtaatttctacaatttttactcttagaagtagtgtggagtgatgtgttcctgtcagtccaccacgggtggctcatgttgagccttggtctagtttgctttattaatattttttccatcttaattttaagaagtcacattttctttttttttttttcctttctggctaatagggtttctatgtgattattaagctgacttttagtttgcctgtaaatatttgtctcccatggctggagagtcatgcattgctccttaatttctatacttagtttgctacatttggattccttcctgcagttcttaccaacctcccaaagcctcatctgacagaatactagatccctatgaccctgactaaaagaaccaagtatattaagtcaaacagccacactcacagcgaaggcgacacagtggagtacgtcattctccgcctccaggtcagtgaagaggctcctgtttcccctgacagactccaaggaagcacttacagtcactgtctcattcaggtagctcagaaggacacagcccttctcagtggtctcagtgtggagcagggaggggaccagaaccatatactgcctgggaatgagacggttcagttagaggaaagtgaaggaagagaggcattgctatcaacagcacttttttccatcatcataattatcatcatcagttctacaccaagagaagatgtactgatgagcatgaaatttggccgttgaaggccatgcataagaattatttcccttttccctcacatgccatggcagtgaacattttacttgaggtaggtcttaaacagattaaaacttgtaggcatgcttcactttaaggaacaatttgtgaacatctgaattcaaataaaaatatgtagttacatttgttcatgttgtaaaatctatttttaccttcaagttgctgtaaaaagtaagcaagctctcagtcatgcggacattacaaaaactaatcaaattatagaattttcattaaaatatatatacacacatacatacatacacacattcagcagccctgtgaaaattgtatggtaagcactcgcttccactccacagatatggaatctgagcctcaaagaaagtgagccattacttcacagtctcagttgtggtaagcagctaataaggtcttaagagtgttacctaaccatggatgtttgcattttaaatatttgcctttcagctcatgattagacaatggctccatccaaaaatggtcctctggtgattgactttagaccttggtaactcatgtgcagtacagaaactttctcagtaccctgacatgtaatttaagatcaaccctgtagtttttatacatttttgctcacagaactcctaaaataatttttggactctgtgcactccttacatattttcaagtaaacatatttttatcatgattttaagtaatagcaaaagatattatttttgatgatattttaaattaatacttagattacttttacaattttctcatgaataataaacactgtagtataagatacctactatcactatttaaaagtacattaaaaaattcttttaatggtctgatatttaatatctttctcttcttttttcctttttgaatttgaatttccatgccaattaccatacagaaatttatcctaaatttttatatttcaaaaaatgttgtgaattattcttacttctttattgtcaagcatctatacatatacgtatgtatacttatgttcacatatatacatatatgaatacatatacataaatacatatatatgtaacatatgtgggtaggtaaatttaactttaactcctcttttaaatagaatgtaaccataaatttataaatattaaacatttccttctgactgagctatgttcaaaaatacttgtatataactgatcaaaacaaaataaatacaaagtatgattcatacatattagatataaaattaaaatacttttgaagcacatctttaatgagaatgatgagctgttttttcccccagtgaatttatgcatccatggattgcaagaattaaacaacattaattctgttactatttttgttttgtgtagctataagtgctaagaagaatggctcacataaaagtaaataaatggcaggtaaaacaattgcatcattgttaccacttcttgcaacttctgcattacatgccaaaaatcacctagtactctattatcaagaatcccttctcatcactcatcagctggtatttccttcagttcctccttcagttgtgttgaaacaaagaattcatcaccacctcatctgcaaaaggatttctcttctgacattagagtcccttgctttttcaatatcaacaccagtatttcaaattgttcctttatttggcactctatagatttttatactccagggcattgttccatgtttggttgtgggagagaattgtctttatttttataaaatagaaaatggacccttgagaaagaggaaataagaaaagataaatagcatggtctcaagtagatcaatatgaatgtgaatatctaaaatttattcttttaaaaagctaaaaatttctgacaccccttaggaaggctttgcatattagagcttcagagagttggggaagaatgattaaaagtaagcaagtaatgagtaaactagatttgtaaaatctggaaggaatcttagagataagaagatgacagtatcataggaaagaaaaaggaatgatataaagaaaaatctgcaataaatgaaggactctaggttcatgcttcacgctctctgtgtggaactcacggttttccagagactgaggcgtctgtgggcaggaggaccaagaggagaagaaccagacttggatgaaggagtttgttcttccccatgttgcagaaagaaggagctggaggagaacagactgtattgtaccctactccctacaatccatctggtcccaaacacttcccaaagcaactgggctttatgctgctctgtgtgc

SEQ ID NO: 319 - DNA, 158487 bp, Homo sapiens
agcaatcagcgagattccgtgggcgtaggaccctccgagccaggtgcgtgatatactctcgtggtgcgccgttttttaagcccgtcggaaaagcgcagtattcgggtgggagtgacccgattttccaggtgccgtctgtcacccctttctttgactcggaaagggaactccctgaccccttgcgcttcccaagtgaggcaatgcctcgccgtgcttcggctggtgcacggtgtgcacagccactgaccttcgcccactgtctggcactccctagtgagatgaacctggtacctcagttggaaatgcagaaatcacccttcttctgcgtcactcacgctgggagctgtagactggagctgttcctattcggccatcttggctcctccctgaaagctctgttttatttcttttcttttttttttttgagatggagtttcaggtgggcatggtggctcacacctgtaatcccagcactttgagaggccgaggtgggcggatcacttgaggtcaggagttcgagactagctgaccaacatggagaaaccccgtttccactaaaaatacaaaattagccgggcgtggttgcacatgcctgtaatcccagctactcggaggctgaggcaggagaatggcatgaaccggggaggcggaggttgtggtgagctgcattccagcctgggcaacaagagcaaaactccctctcaaaaaaaaaaagaaaaaggaaaaaaaaaaaagagacggagctctgtcagcaggctggagtgcggtggcacaatcttggctcactgcaacctctgcctcccgggttcaagtgattatcctgcctcagcctcccaagtagctgggattacaagtgcgtgccaccatgcccagctaatttttgtatttttagtagagatgaggtttcaccatgttggccaggatggtctcgatctcctgacctcattttctgccagcctgagcctcccaaagtgctgggattacaggcgtgagccaccgcgcctggcctatttaattcttaataatgctgtgacgtataggtgtatggtagagtgagagacctgggacataggtcttactggccctaaacctgtgttctttccacaatattctttgctgctttacaaaaagccagaaaggcatttagaaatctatttttaagaacttgtcatttgattatagtacaggatttataggaataaggggattcataaagtcttgagaattttaatgcagtcaggttggctaggaactcagccaatttgttttctttcctcaatttcttcttaattatttgtatttatataagcatctttactgcagaggccaaacctcttattcttaaattcatagtccactaccatttgtctgtaatcattcaagctttatcaaatttattatgtctcaaagcactccaactggaattgccattcctggaacttgttcttcttgttctcattttggtgtctttgttcatgctattctgtataagagagtgtgcccataacataaggggtaggctgtgagtggcatacattttcctgtctcctacagagactgcttgactccctcatctgtacgtgttaaaatcaccccacattccaaggcccagttctttaggaagttttcttcagtgtcttcaataggagtaaatctctctcagttccatttgcccaaggatcttctggtataatattgatcaaactttatattgaattatattgattaatgcttttttgacaaatagttaattcctaatatgtgtacaaaacctttcttgttttctccactaaatcatagcatattttaggataagagctcagtattactattttttgtatcccttaggctacagcaaaatatcaacacagtaaacatttaattgatacttgatttgatggtgagctggcattagctgactgtacttactaataccagattctgactggcttgtcttacattactcaggagcattattaatcatatttaagtgaataaatctcattatcttctcccctagaatcatacttcactgtccaagtgaaaagcagattattcacaagtcaatgcctgtattttagaacttctactctagtaaattttaattagttttcacacttgaaattgtcaaaagtgttcaatccagagagactccatcctgaatagggtctgggtaaaatgagactgacacctactgggctgcattcccaggaggttagacactcttagtcacagaatgaggtaggaggttagcacaagatacaggttacaaagctcccgctgataaaacaggatgtggtaaagaagctggccaaaacctgccaaaaccttccaaaaccaagatggtgatgaaagtgacctttgatcatcctcactgcttattagatgctaattataatgcattagcatgctaaaagatactcctgccagcatcatgacaatttgcaaatgccgtggcaaggtatggaagttaccctatatggtctaaaaagggaaggaaccatcagttccagagattgcctgcccctttcccagaaaactcatgaataatccatcccttgtttagcatatgatcaagaaataaccataaaaatagacaaccaacagctactctgcctatggagtggccattcttgtgtttcttttctttctttctttttttttttgagacagtcttgctccattgcccaggctggagtgcagtggcgcgatctcggctctctgcaacctctgcctcctgggttcaagcaattctcctgcctcagcctcccaagtagctaggattacaggcacatgccaccatgcctggctaatttttgtatttttttttaagcagagacggagtttcaccatgttggccaggctggtctcaaactcctgactttgtgatccacctgcctcggcctcccaaagtgctgggattatggatgtgagctgccatgcccggccgtgtttctttctttctttctttctttctttctttctttctttctttctttctttctttcttttttctattcacaaagaaaaagctccagtccatttttaaatttttttgaaaaattcctgactttacagtactaaactgaaatgtattaatattccattcttaacatttccatgacagacagaaaaattcatgagccaaaacaaaacaaaacaaaacaaaacaccaaaaaaaaaaaaaaaaatcccaggtagaagcttataaaactaaatatggatctcagcaccaacagctgaacagagaaaggaattaaaacactttaagtaaaaaatcacgagtggatgataaagtgtgtagaaactgaaaatttacaaactatttaaaacctgaaatcgctgactgttcagaaactacacagatggatcatgggtggtggtgaacagcagaaagggattgtggataaatctgcattgttctagctgctccccatgccacccgtctccgaggaaagcctgacattgattagatattgagccaggctaatgctggcagcagatccagtgatggtaacctgcctatcagtagatccttccactgggttcgcaattttgatctgtgccccagacatctgacggatctcatttattttggcgccttgacgcccgattatgcagccaatcaaatcgtttggaatggtaagttcatgagaagtagtctgagcagatgtatccaaacctgcactgaatccagtgttgccatgcgtcatgggaaaatgagactgttgcattgccaactggtgcagcatggtcaaatctggctgtggaatggcaaactgtccttgaagggtataggcctgaccgcctgcaaagatgaccggagagctggaaggcttgagctggtacgggatggtcacgcccttcgggggggactccaacatgaccacacagatctgtttgacacactcaatgatggattgtgggatgccagcaatagtgatggcctgctcagttgagttgggtagcatatcccctgccatctagacctgagcccctgtactctctcgtatttccttgatcttgcaaccaccttttccaatgagagagccacactgactagcagggaccaccagcctcagggtgactgggggtctagtggcagctgtgctactggtcatagagctgcttatgtcctcttccagtttgtcaatgatcatagcaaagcctttgaagacggcattagcaggtccagcaaaagtgataattctctcaggacaattcccttctgagatgttgataggtgcaccactctcctcgcgcatcttcttaactgattctcctttctttccgatgatactgccaacttcctttccatgcataagtagtcggatggtgagagtgatatttaatccaccttcaatcacactggtttccatgtcgagcagtgttctggggagctggactttgagtggtcaagtctttggtcactgatggggggtgaaagccaaaaactgctggcgcgaggcgactgaggggaaaaggggaatgggctggaaggggaagggcgggaggccgggggcggaacaataggggcaggcgggaaggtgagggggggccccgcgggcgggcggaggaggaaggtggggtggaggaggaggaggaggaagggggaaagagaccccggggcgggtgggggtgccgtggagggcgggcgggcgggagagggtgcagactgcggctgctcaagctgctctgggccggccttgtttctttactttttttttttttttttttttttttctgagacggagtcttgctcttgttgcccaggctggagtgcaatggcgcgatcttggctcactgcaacttccgtctcccagattcaagcgactctcctgcctcagcctccctagtagctgggattacaggcatgtgccaccatgcctggctaatttttgtatttttagtagagacgaggtttcaccacattagtcaggctagtcttgaactcctgacctcaagtgatccttccatctcagcctccgaaagtgctgggattacaggcgtgagccaccgcacccggccgtttctttacttctttaattaacttgctttcactttaccctgtgagctcatcctgaatttcttgcatgagattcaataactgtcccttagggtctggatcagaatggctttctggtaacaaaatgactgattgttttttgtcactgtgtcttaagacccatattctgcccttcatgattatcagtcacatgggcccttgttgcaccctaacttcatttctctagaagacagctcttctttttgggttccttaggaccccgccttcctcccctcatcaaagatgcagagtctgtggtttaggttgccattacttgcatgctatttttacatgaggggtaactgaccgaattttaatactaattagctgtgatataatacagacacagcaaattctgcccagggaggaactttgtaatctgactcaaaagcttcgtgggctaagcaggagagcatttaacattcactgctcactgatttgattccttagggcatttcacaatgaagtattgaaaattttcccatttattgtggtcttgtgacatttagaagggaaatggaaataagcttgtgagtatcctatttaagagttcttctctaattttgtaagttatgagttccctcacaaattttataaggaaatctagagtagtgttagttgagaagaaaatacttggaaagaagacacttgaaagtaatgcctgtgttttggggaaccacgatgaggaaattagctgcaatatgaccttgaaaggaaattttagcactttgtaaataatcaagttatttgtactgaaagagttccaacaaagaaaagaacatttttgatagtcaaataattcaaatttgaatgaatcacaaactagaaataaaaaactaaagaactggaaatgataacaaaggcaaaatataaacgaccttctaattgtttatttctctttaaaagacaatcaactgtttaaataaattatagtatcaatgtattattgttgtaccttagcgagttagagaaaatgccacactttgagacaaattaagagtctgttgatttagccggcggccaagagacggctaacactcaaagttctctggccccgaagaaggggctagattttcttttacactttggttcagaaaggggaggtggggggtctagttaaaacaattttacagaagtaaagtaggcaaaaaagttaaaaggataaatggttacaggaaagtaaacagttccaggtgcaggggctttaagactattacaaggtgatagacgcggggctttgggtgttatcaatcggatgaattcctgggaactgtggatatagcttgccacagtatcttatcggttaattgcattcttggatgtgctgggagtcagcttgcacaagttaagtccttgaggaaggggctgccagtgaaagagccaagatggagtctgtctggctctcttagctaagggagagtcaattcaggtggaaacaaggctaggtgattaaagtaaagggagagtctaaaaacagggttagtgaaaacaaggttgggcattacattatgatatttataacatatgtagaaataaaatatgtgacaatacaatcacagaggccagcagggaagaagtaaaagaatactattttaaagttctgatgtaatgtgaaaaatggtataatttcacttaaaggtagattgcagtaagttaaaaatttatacaatagttctcacttataagtgggagctaaatgatgagaacacatagacacgtacaggggaatgatagacactggggcctacccgagtgtagagggtggaagaagggaaaggatcaggaaaaataaccagtaggtactaggtttgatacctgggtgacaatctgtgcaacaaattcctgtgacctatataataaatctgctcatgcacccctgaacttaaaataaaagttttaaaaaattgtactttaaatcctaaagcaaacattaaaagaacacaacaaaaacatagctagtatgtaacaaagaaaaaaaggcagataaaatgaaataataaaaaaccctcaatcctaaaggcaaaaaaggacaaattgaacattaccaatagccgtattaaatgtaaatggcctaaaaatcccaactaaaaggcaaaaaaattgaaagattggagaaaaaagcaagatccaactatatatagcctataagaaacccaccttaaatataatgacccacacagagtaaaacttaaaaaaaaaaaaagatttgcttgctaacatcaatcaaaagaaagctggagtggctatattaatatcaaagaaagtagatttcagaacataaaaataatagtagctataagataattaattcacaataataaagggagtgagttttttaggggaaaatgatattaaacatttaagcacttaataatagagcttaaaaaatacacataacaggccaggcatggtggctcacgcctgtaatcccagcactttgagaggccgaggtgggtggatcacctgaggtcaggagtttgagactagcctggccaacatggcaaatccccgtctctactaaaaatacaaaaattagccgggcgtggtggtgggtgcctgtaatcctagctacttgggaggctgaggcaggagaatcacttgaacccaggaggcagaggttgcagtgagccaagatcatgccattgctctccagcctgggtgacaagagtcaaactccatctaaaaaaataaaaatacacaaaaccagaactgatagaacaaaaaggagaaataggcaaatctaccattttattcaggaatttaaccctttttcagtaattaatagtataagtgaaatacaggtttagtcactcactgctcatggagttcaattaataagagcaaagtctggtataaagaaagtgactctttattacaaaactagcttagcggaagtacagccttcctgtcttaagggtaccgcttcacctttggatcagaaagtggttgcttttaaagggggcctattatgaatggcacacaagggagaaagcaagcaggtgtgggaggtgtctacatgttagcttggtgccttatctattgggcagttgaattggcatcttcattggcagaaatattaatagattgtaaaggtgtccaaaaactctccaggtgggagagaattttgcatgggactttgggttgtaaattggcggctgtctcttcagacagtttcctggtaggttaaaatttcatagcaggcatattttaggttgtaagtcaactgttaactcttggatcaccttttcggtgggtgagagttctgctctagagcttctaagcacataattagatgaacttgccctatagggagtgtctggggaagaagatgtaaaaggttataattgcatttctaaagggctaaataggaaatagggaatgggggaaatggagaaaggagaaaagaagagaaaataattttttaaattgtaactctttttttctttaacaactgggttactcagttacgataagatgaagagaaaaaaacatctataagaatattgaagtcttaacactatcaatcaggttgaccttattgacctacaaagagcactccatcctaaaaaatcagaatacacattcttttcaatgtatattttatgtgtatttaatatatagttcacactaaatatttaccaagatagaccatattctgaatcataagttaagattcaatcaattaaattcatacaaagtatattgtcagaccacagttagaaatcatgaatagaaaaatctccaaatatttgaaaattataaagacatttctaagtaaactgtgtgtcaagaaaggaatgtagaaaatattacgaactgaatgaaaatgaaaatacagtatcaaattttgtgagatgaagttaaaacaaaacttagtggaaaatttatgacaccaactacctgtattagaaaagaagaaaggtctcaagtcagtaatctcagcttaagttttaagaaataagaaaaaacaaaataaaatccaaagtaaatactttttaatgttacagaacataataataaaaaccagagcagaaattaatgaatgagaaaacataaaagtaatagagaaaattaataaaaacaaaagaatttttaagattaataaagttaataggctttttggcaaccagtgataaaaataagagtaaatatgcaaattaccagtgtcaggaataagatatgtgacatcactaaagagtttattgatattaagaggataataacaaatattgtctcttaaaatatgtgaataaatttgactacttacaagaaaagaacaaataccgtgaaagataaaaattaacagagtttactgaggaagaaatagataacctgaatagtcccatatttagtaaaatagttgaattgtagttaaaaattttttacacaggaaactttagacccagatgcttcgctagggaattctatcaaacatttaaacaagaaataaagccaatgctatacaagttcttccagaaaattataaaagagaaaatatttttcaaccaattatacgatgccagcattactcaaacaccaaaaccagacaaagatattgcaaaggaagaaaattgcatgccaatattcctcataaatgtgatacaaacctttctaacaaaattttaattgatcaaagttaacaacatataacagtgataataagtcaaaaccttgtatgatttattccaagaatgcaaaatgagtttaacatataaagatcaatcaatttaatatgccagattattagactaaaaaaagatactctcatttaatgtaataaatgtattttatttataataataaataaataataataataataaataatacttattcttaacctaaaactctcagctaggactaaaaagagagtgcttcaacccactatgaacatatgtgaaaaacctacagacaacataatacttaatggtgaaagaaaattctttcttcataagaccaggaaaaatgtaagaatatttactctcatcctttgtatttaacattatatcgaaacttccagctagtgcactaaaacaaaaataaataaataaattaaagatgttgatattggaaaatagtagtcctgtgggaaatgtatggcaccaactacctgtaatggaaaagaaaaaatgtctgaaatcaatcatctcagcttacatctgttctttatttgcagacaacataatcatccaaaaaaaaaattctatggaatcttcaaaagatactagaataatgtgtgaatttaacaaggttgcaggatgcaagattaatatacaaaatttaattgtgtttgtatattcttggaatcaataattttaaattgagttaaaattcaatatcatatacaatagtgttcttacttatgaaatagagaataatcttcaaaaggtatgcaagacctgtaaaatacaaactatacaatattgctgagaaaaaatttttaaaacttatgaaaaggagagttatgttcatagtttggaagattcaacattgttaatatgtcaagtatctaaattaatctataaatttctcagcagtccttttctttttaatagaaattgacatgctcattctaaaatttatgtagaaatgccaaccactgagaatagccaaaaaaactctgaaaaaaaagaggcaacttggaagacttacatttcctgccttcaaaaacctttataaagctacaataatcaaagcagtatgatattggcatgaggataaaatatgatgagttcagaaatatactcacacatgtacagttaattgatttttgacaaggaaccaaaggcaattcagtggagaacagataggtttttcaataatgttgctgtaacaattgaatatcaataattcaattgaataacaattgaataacaacaccccactgcctaccttacatcatatacaaaaatgaattcaaaagaaattatagaccaaaaagtatcaagctaaaaatacacaatctctagaagaaaacataggaaattggattaagtaaagactgcttagatataataccaaaaacataattcacaaaataaaacattgataaattgaacattatcaaaatgaagaacagctcttagaaagacactattaagagagtgaaagataagtgacagtctgctagaaaatatttgcaaatcatatatctgataaagggtttatactttgaacataaaaatctttcaaaactcaataataaaaataatgtaatattggcaaaatatttgaatagacgctacatcagaaaatatatataatggcaaataagcacattaaaacactaaacatcaatttttcattagggaaatggaaagtaaaacaccatgagataccattgcacacctattacaaatatcttatattaaaaacactgacaacatcaaatgttggagaggatgaagagaaactggaactcttatatactgttggtggaaatataaagcagtaaaactattttttgaaagaatttggcgatttttaaaaaaattacataaattacatgccatttaatttgattaatagttgattttaaaatgacccttcctaaatggccatgtgaatagtatttgtgagccttttgcaagatgtctgttaacatcccctgctgtaatgtaaaaaacacatttctttaataatcttgcttcagaaagtctctcataaatagtacattttatttatttagacaaggagaattatataatacataatacttttcttttttactttgtaaggacactacgaacaaaatgtaatgtttcatgattataaatctcttaagctgtggttttcatttatctgttccctcagctttatggctcctcatgtaaatttgcagaaatccatccattcatccatccatacaccacctatcatgattgataggatgttcaactatttggaatgccagtagaggaaattgtgaagcaggtttactctgcaccagttgtttgcctgacttgggtgtgatagaacactcacacaaagttacatgaaccaaatttgttacttacagatagacggcaagggacaaccaaagcctgggattcagggcaagctcatcccccgaagctcaggaaagctacttaaggtgaacagagtcttatcttcaagtgctccacttgcaccacaggtgtaaaacgcctgccttgggctttgtaccccagtggccgcatgacaccttgggcaaaagtgctgaaggacaccctgtttctagggccaactggaacagagcctggactgttccagctacctcttctttatctcacaatgttccattcccagcacattctacaggtatccttgagaattacaagtgagaaagtggagagaattgggttggtccacttccattcagagttggtccactttcattcagagaactgtcctgcagacttgtttagaggtatctatttcagcatttctcatatcttcacttattagtgtctgtagctccaccatttctatctaagctcactctgaggtaaaagagccaggattttaatagagaactgacataccttagcttgggttgagagaataactgtagttgagcagctaaatcttctcccctgcttgccttctgcttggacagaggtcatgctcgttactaggtaatttatatacatgtaatctggaaaaccaaaatgcagtcaaagcatgagttatcatttggctagccatagaagaaaagaggagtatccttctaatcatctttacctttagaaagtctggaaaatgaccatttgtctgaataactaaactactagttttattaagtcttaaaagtcattttatgctgtaaaaacatattgcttttaatacattttagttatttttctttcttcatgtgagtgtagtaaaagaagcaggaaaaataatctaatacgtatctattaaacaaaaatgtttttctgcagttcccgagagatcccatgatccagagacaaaggtggcagctttggagcaagtggagagccagaaaaggatccagaactggagtggaaggtgggaaagatctttgagtgcagctgcactgtgtgggaagacaaatatgataatggacaaacagctgtttgaatcagacagtgaaacctcactaaagggagaaaagggagagcgttgctgatgagagaggccacggctacagttttgtgggtagaggttcagttatgagggctaaaatgcttagacagaaatctctgggttgaggctgaaagaattggagaccggcaactacaaatatagcaagtgtgtttcttcttgctctcaaaatatacttttagcactttggagtgactggtactatatgaacatcacacaatattgtagacaatctgagcttagtattcaagaagggtaaggcatacaatgatgatcaactataatattcttgatattcatgattttgaaatcagaacagctataccatttgcaaagagagagtccatgtgttttaggccagtgacaatgactgtgtttctttcatctgcatgaggcactaaactgaatgggatggagataaatagcctaagaggcttgatggcagggattcatttttttttcacccgagacagagtctcgctgtgtcaccaaggctggggtacagtggcaggatcttggctcactgcaacttccgcctcccgggttcaagcaattctccctgcctcagcctcccaagtagctgggattacaggcacccaccaccacgcccggctaatttttgtattttttagtagagacggggttttgccatgttggccaagctggtcttgaactccagacctcacgtgatccacccgactccgcctcccaaagtgctgagattaccggcataagctgccatgcctggcctgcagggattcaatttttaagccattatcaggatttgttgatctggttttgaggttttttttaaatatgatggtcagatctagtcagaagctactggccatgaattaggtgtattttggttatgcattgaattttagatatttacatgaatttaattgatggagacagtagttttatatatttagttttctgaatctttatcagggactttttcctgtaatttgagaaatcctaataaacgatttcacatcttcctcaaagtaacatagaggattcaaatagttgttcagatgatttaaatgttgtgattttactcagttgcctaacattttaaattatttctctttcttctcctttggcttggaaacagtggcaacagtaacttctaagagttgaatattattgaatcctttctctgatccacctactaggttcagtattttaaaaacacaaattatatagtcagataatctttgttggccttttatgcctattaaaatatctgttaaaaatatttcctctatttattttgatctttttgtcttttttctctgcattcagaatcattatcttctacctgttctctaagacagtgatttgatttttgacagtggctatcctggtccttgcttttataattgatctatttgatctatattggtgcttttaaattctcaacttattgtctcattctttaaaaaatcatatatttgggttctagtttttcttgaattcatatgcttattaaattcttttataacttgaacttctcaaaggcaaattgtcttctaatccttgggtagtttttctttacattgctttccccttataatattttcctttacttgtatttcttttctttatttctattctgattcctatttcttttctttttttctctttcctttcctttcttctcaatttaaaaaatatatgctacttcttttaatctagcatattttaacaataggaatttttcagaccaactttttgctctgatatagggtggatgaatatttttgacactgttaccactagggatgacacagaaaagacaatttcatcttttttttttttcactagattgaatgcagtttttccccatgagacaaaatatccctgaattttctttttaagttcctcttaagaaggtttcagaattcctctatagctcaaagcatcaaaggaagaaccaattttaatttgactttgctttaggtgaattaaccatcttcctagtcttttattttctttaacgatttgctgtctctcccatgcttcctccttagaacagctgctctctagcctacttcattgacagcaccagccaagtgaataggtcagagaagagaggtaaggaagccagctgtgtgggttgtacctccctatggagccagttaatgacacacggggctcaatccaccatcttctgcttttccctacaaactcaaatattctctgaacttcagctatcaccatcctggtaattacacctactttcacaactctagctctaatgtcatcctgagagtagctcatcttcacatgtgagatcctttcatagaatcaaagattattgcagccagaagctgagtccactgtgcctcatccccatcttgaagatgaggaaaacagaggactggcagaaggtgggtacagaatccagccatgttccttttagtccagtgttctttcatctcactttactgtatccactcttcaaactcaatatttcaaaatataatttacattttccctgataactagctctgcatttcagtttctcagtgtgactggcaactccattgtcttgtgttctcatcttctttttttttttattatactttaagttctagggtacatgtgcacaacatgcaggtttgttacatatgtatacatgtgccatgttggtgtgctgcacccattaactcgtcatttaacattaggtatatcccctaatactatccttccccactccccccaccccacaacaggccctggtgtgtgatgttccccaccctgtgtccaagtgttatcattgttcgattctcacctatgagtgagaacatgtggtgtttggttttctgtccttgcgatagtttgctcagaatcatggtttccagcttcatccatgtccctacaaaggacatgaactcatcatttttttatggctgcatagtattccatggtgtatatgtgccacattttcttaatccagtctatcattgatggacgtttgggttggttccaagtctttgctattgtgaatagtgctgcaataaacatatgtgggcatgtgtctttatagcagcatgatttataatcctttgggtatatacccagtaatgggatggctgggtcaaatggtatttctagttgtagatccttgaggaattgccacactgtcttccataatggttgaactagtttacagtcccactaacagtgtaaaagtgttcctatttctccacatcctctccagaacctgttgtttcctgactttttaatgatcgccattctaactggtgtgagatggtatctcactgtggttttgatttgcatttctctgatgtccagtgatgatgagcatttttttcatgtaaatgctcatcgtcactggccatcagagaaatgcaaatgctttgattcttctatattttatatatataattatttatcatgtctgttaaattttatgcttaataccatgtctcaccttcctttctttttaagtattactgtccctatactctgaggacgttatgtttatataattgcagtattctattttgcatccctgtttttgattttcatttcattcatataaaaatataatctgacagcaattgtataccaggcactatggatatgtggtgagatttcattgtaaatgaaggaagtaaacatacattaaaggctgtagatagacttgttttctctgcttctttccctcgtactctgtcttaaacctacctgactcaggcttttgacccatcacagcaccaaaactgttcttgctctgtttactcttgatctgacttctgcatggctaaatctaatggttaagaatgagtcctcctcctatagactaggtgtcatttagcaaatgtttctgaggatatgccacatgccagctctgtttcaggtattgaggctatgaaggtaaaagaaaaaaagattaaaaaaaaaatcctggcccttacaaagtttacattccatgaacatcctttgaaaaagttgatcatactctactctcttattaaatacttactttcctcactattcctttagatacaactctttaaacatttttaatttttaatatataggagtacaagtatggatttcttacatacatatatcatatagtggtgaaatctgagattttagtgtacccatcactcaaatagtgagcattgtacccaagaggtaactttttaatcctcactcccttccacccttccaacttttggagtctccagtatttattattctgctccgtatgtccatgtgtgcccatcatttagctctcatttataagtgagaacatgcagtatttgtttttctgttcctgagttattttacttaggataatggcctcaagttccatccatgctgctacaaaagacattatttcattattttttatggctaagtagtattccattgggtgtgtgtgtgtgtgtgtgtgtgtgtgtgtgtatacatacatacatatatgcacacattttatataaaaatgtggtgtatatacatatatatatgtatatgtgcacatacgtgtatatatctgtctcacattttaaaaatccagttctttgttgatggacacttaggttgatttcattactttgttattgtgaatagtgctgtgataagcatacaagtgcaggcatctttttgatataattatttcttttcctttgaatagatacccagtagtgagattgctggatcaaatggtagttctatttttagttctttgaaaatctccatagtgttccacagaggttgtactagtttacattcccaccaacagtgcataagcattccattttctccacatccttgccaacatctattgttttggactttttagtaatagccattctgactggtgtaagatagtatctcattgtggttttgatttgtatttctctgatgattagtgatggatacaattcttgattcttctacctttctggctgtttcttctcagtctcattggctgcacaagactcaccttctcaacttctaaatggggaagtgccgtactattcagtccttgaaccttttctctgcttctccagatgcatctattcaccatgtgatggcccccaattccatcgctttaagcactatttagaaacttgcctcagggctctcttttctcaaatgcttctgatcagcaggcactctttgaccacttgatcaagattgaacctgctcaccattttccgtcctcttgcccaattttattttttaatagaatttatcactatcagtttttacatatcaatttgcccatttattaattttctcctcctatcagaataaaagctccatgaggaaagggacattgttttgttcactgttctattccaagtgccccaagtaactggcacatagtcagcactctgtaaacattcattaaatgtataaataatgataatgagagccggaagggagggggcttatagtacattaagagtatatttgatgtgatccatcacattaacagaatgaaggacaaaaaccatatgatcatctcaatagatgcagaataagcatttgacaaaatttcacattatttcatcataaaaacttgcaacaaattaggtatagaagaaatgtaccaaaacaaaataaaagttgtatatgacaagcccacagataatatcaactcaatggtgaaaagtttaaagattttcctgtgagataaggaacaagacaaagatgcgcactctcaccacttctattcaacatagtactggagattctaaccagagcaattagacaaaagaaagaaataacatgcactctaactggaaatgaaaaagtttaattgtctctgtttgtagatgacatgctcttatataaaaaaatccctaaagactttatacaaaaactgttggagctaacaaggaaattcagtaaagtttcattatacaaagtcaacatacaaaaatcaataacatttttatatgttaacaatgaactatttgagaaaacaatcccatttagaacagctacaaaaagtacttaggaataaatttttttaaaaagctgaaagatctgtacactgcaaattataaaacatttttgcaagaaattgaagaagacacaaataaaaatatatcctatgtacctggattggaagaattaatattgttaaaatatccatactacccaaagcaatatacaaataaaattcaatccctatcaaaattctgatgacattttttaaagaaataaaaaaaaattctaaaatttgtatggaaccacaaaagacctcaatagccaaagcaatctacagcaaaaagaacagagctggaggcatcacactgtcagattttaaaatttattacaaagctatagtaatcaaaacagcatggtactggcaaaaacagactcatagaccaattatatttgtctattcacacactgctatgaagaaatatctgagtaatttataaaggaaagaggttttatagactcatagttctgcattgcttgggaggcctcaggaaacttacaatcatggtggaaggcaaaggagaagcaggcacattcttcacagggtggcaggatggagtaagtgcaagcaggggaaatgccagacacttataaaaccataagatctcgtgagactcactcattatcacaagaacagaataagggaaacagcccctatgattcaattacctccacctggtcccaccttgacatgtgggaattatggggattacaattcaagatgagatttgggtggggacacaaaacttaactatatctttttgctctggcccctcccaaatctcatgtcctcacatttcacaacataatcatgccttccaacagttgcccagagtcttaactcattccaacattaacccaaaagtccaaatccaaagtctcatctgagacagggcaagtcccttctgcctatgagcctgtaaaatcaaaagcaagttagttacttcctagatacaatggggatacaggtattgggtatagccattccaatgggagaaattaactaaaacaaaggggctacaggccctgtgcgagtctgaaatccaatagagcagtcattaaaccttaagttccaaaattatctcctttcacttcatgtctcacatctaggttatgctgatgcaagaggtgggttcccgtggtcttaggcagctctgcccctctggcttcacaggatacaacccatcctggctgctttcactgctggcattaagtgtctgtggcttttccaggtgcatggtgcaagctgttggttgatctaccattctggggtctggagaacagtggcctttttctcatagctcctctaggcagtgcccgcatggggactctgtgtggggtcaccaacctcacgtttcccttctgcactgccctcacagaggctctccatgagggctctgcccctgcaggaaacttctgtctggacatccaggcatttccctagatcctctgaaatctaggtggaagttcccaaacctcaattcttgacttctgtgcacacacaggcccaacaccatgtgtaagctgccaaagcttggagtttgcactctctgaagcaatggcctgagctgtatgctgaccctttttagccagggctggagctgaagcagctgggacacagggcaccatgtcctgaggctgcacagagcagagtggccttgggctgggcccctgaaaccatttttcccacctaggcctcctggcctgtgatgggaagggctgccatgaaggtctctgaccttttccccattgtcttggtgattaacattccattcctcattacttatgcaaatttctgtggcaggctggaatttctccccagaaaatgagtttttattttctattgcatggtcaggttggatatttttcaaacttttatgctctgctttctcttgaacactttgccacttagaaatttcttccaccaaatactctagatcatctctttcaagttcaaagttccacagatctctagggcagaagcaaaatgccaccattctctttgcatagcaagggtgacctttactgcagttgccaaaaagttcctcatctccatctgtgatcacctcagcctggacttcattgtccatattgctgtcagcattttggtcaaagccattcaacaagtctctaggaagctccaaatcttcccacatcttcctgtcatctgagccctccaagtctctaggaagttccaaactttcccacattttcctgtcttcttctgagtcctccaaactgttccaatctgtgcttgttacccagttctaaagttgcttccacattttcacatatctttatagcagcactccactctctgtggtatcaatttactatattagtctgttctcacactgctatgaaaaaatacctgagactgggtaatttttaaaggaaagaggtttaatagactcacatttctgcattgcttgggaggcctcaggaaactttcaataatggcagaaggcaaaggagaagcaggcaccctcttcacagggcagcaggacagagtgagtgcaagcaggggaaatgccagatgcttatgggaccatcagatcttgtgagactcactcattaacagcatgggggaaacagccacaatgattcaattgtgtccacctggtcccatgcttgacatgtggggattacaattcaaggtgagatttgtgtggggacacagagccaaaccatgtcaccaccggaacagaatggagagctcagatttttaacaaggctgccaagaccacgctgtggggaaaggacaatcttttcagtaaatagttttggaaaaactatatacccacatgcagaagaatgaaactagacccttatcttacaccatgtacaaaaaccaactcagaatggattagagactcaaatgtaaggcctgtaactatacaattactaaaagaaatcataggttaaaagctctttgacactggtctgggtaatgattttttttgggtatgaccccaagagtacaggcagcaaaagcagaaagagacaaacgggattatatcaatccaaaaagcacctgcaccgcaaagaaagcaatcaacagagtgaagagatgacctatggaatgggaagaaatatttgcaagctatgtatataataagggactgatatctaaaacatatgaagaactcagataacttaaagtcaagaaaataaataatccatttaaagaatgggcaaagattctgaacagacattttcgaaaaggtaaatgaaacaacaggtatataaatggtcaacatgtatatgaaaaaaaatgttggctgggtgtggtggctcatgcctgtaatcccagcattttgagaggctgaggcaggtggatagcttgagctcaggagttccagaccagcctggccaacatggcaaaaccctgtttttactaaaaatacaaaaattagctgagtgtggtggcatgctcctgcagtccctgctacttgggaggctgaggcatgagaattgcttgtacctgggagatgaaggttgcagtgagacaagatctcatcactgcactccagcctaggccacagagtgagaccctgtctcaaaaaattagaaaaaaaattttaaaaagaaaagacgaaaaaagaaaaaaatgctcaacatcactaatcatcagccataatgaggtatcaccttacctatcagaaatggctattattaaaaagagaaacaataacaaatattggtgagcatgcggggaaaaaacgaggcacactgttggtggaaatgtaagttagtacagtacagtcattatgaaaaccaccgagaggttcctcaaaaacttaaaaatagaattctgtcatttgcaacaatatggatgaacctggagagcattaccttaagtgaaataagccaggcacagaaagataaataccacatgatctcacttataagggtcacagtagcagaaagtagtggttacaaggagactgagggcagggtattgggtagatgttggtcaaagaacacaaatttcagtaagacaggaagaataagttcaagagatctgttgttcaccatggtaagtatatttaacagcaacctagtgtatatctgaaaatttgtaaaagagtagattttagtgttctcatcacaaaaaagataagaatggtaggtgattgttaggttaattagcgtgatttagccattccacaatatatacatacattaaaacattatgctgtaccacataaatatatatcatttttatttgtcagtttaataaaattgaaagctcagagaaatttccttaggtgggggtgacaattggggacattttacacggagggaacatgtgctaaggccctggggcaagaaggagaacatgcagtcaatgtaacagaagatgtactcatgtcactgaagtgtacacagtgtcggggagaaaagtagaaaaggagactgagcagataggcaggaacgtcaactgttcagaacttaaagatcatgataaaatgtgtttttttaattttaaattttattctaaaataaatacaatgtcattattaaaaaggtcttttaggactttttaaatggcacatctttcagtggagtcaggtactaacataaaacttgttttttctctctatgactgtggtcagcatactctgaacacgctaagtaaccaaagacttgagaaggctaggtgtgtattcagtatgacaaagatgcgaaaagaaacaaactgggtctgtgattcatttcttctggatctcagaatagaattcttcatgttaggtctttatctcaattgctacatggcttgatgatctgtatataagggatattgaacattgattaggccagtgaaagagaagtcttgttaaaggttgccagggtgaacaaagttaaaaagctaaaatttttaatcatgaaattagaaaggtactttttcttacccatcttggaagcagtggagccaagcagttatattcccttttacatttggcattctggatgtagtacctttccaaaagctatttatggcatgaccaaaaagagccagcttgtaatattttagttttaccaagagaactaatatatgttttagtttcagcaaagatagaaatcatggagattttggtccaactgattttccatttttttccgggaacaattagccacaaactgttgtatagcttttagggcaccacccaagggccaagtgattctcttcaaattgaaagcatatcattcttttccacatcactggtaccacagccaagtttctgggcttatgtcactttgtctaaagttccaagggggttgatttcacttcaaacatattcttgatctttcttctgggcaaccagtgtggtttgatcagattgactttctgtaaatacactggagaatttttgtggaacctgtctgttattgaaatgaagcatttgcttataatcatgttctcatatctttcagtacacaactggctcttcccttagttgctgttgtttttaaatccagattcccaactatctcctacctgacattctgtgagacagtaattttctggagtttgcatacttgccatgtattgaaaagcagtatttatccattgacaaaaatgcttgtaaatgcatttgatcaacctgctgaaatttcgatttttagagtcattttaatatggcattttcccttaaaattttcaggcctcctggcacttgtgcatttatttgtatttgtttatgtattcctaacacttaaatactttgaggtgtgttctttctgatcatacctgcctgtggaattctgtatagttttctcactccgtctgtaaaataattcaaccagaaatgcaaaggaaggaggaaatatgattctcttttttgagatttagctgcgaaggagttaaggaagaagatcatggaaagttggacagagcacagatgagtacagtaaaggatgaaaacccgtattcacaaaccatatggatccaggagtaaaaattgtgattattattattattttggctcttgtaacctgctgttatggaacctgaataccttttttttttgagacagggtcttgctctgttgctcaggttggagtttagcggtgtgatcacagctcactgcagtctcagattcctgggctcaagtggtcctcctgactcagcctcctaaatagcaaggactacaggcatacatcaccatgccatgttaatttttttaacttttattttgtagagacagagtctcgctatgttgcccaggcttgtcttgaactcctgccttcaagcaatcctcccacctcagcctctcaaagtgctggcattacaggtatgagccacagcacccagccgtgaataccttttatgaagtgcacaaaaatgatagtatttgtagagcacactgaggcaagctatggaaaagatttgaaggcatttatatagtatttggtgacatataattataaaaactaaaatgtaaaattttaaatgtagattttaccaaaatgtagattttgataaaacagcacaaattttgaagtacaaattttgaagagcttgcttctgtttctattttagagagttacacaaaatttctatttcagtgattatctgtccaaaattccaatagatgccattatcaagaaattgtttacccaaatagttaataaagttaaagaatattcttacaatcatttaaagactttgacaattgaaattatattttgtattttgttataatttttcccctttcattgacaaatgtaatattaaagattcttgcaataatataagttgattttggattccaatttgcctttctcacatcaaacatttcaagttgataaaatttttgaacaataatctgtaattattatgcatacattataagagcagtcaccctacagcaatcttggatgcctttaaatggtaaattagccaaaatgcaaagatgaatatttgggaacatcacttataacattaattacagaagccccaaagaggctcctttcttcccccaccctccacactagcactccctggacacctgaaacaggaccgtctccagcagccctctctacaatgcagcactggacaacagctgttgaagtgggtgccccgggagaacagcacctccttggctcactcagagcagagcagcaagtgctgggttctcctccctttttgctgccagcaattatcactggatacctctttagagccacttctcctggggtgacctcctaggatcttcaaatcaggctgctggtcataaaaaatattttgcctcatttcctatacccctaggtcctggcttggccactaagggctgagttgataacttcctttcagaaatttgtagtttatttccattagtgtgctaaagtacagggattgggccatttctttcttataactagtagtaccttctctgtggatggaagtaagagggctcctaggcaaggtgcctgcaaagttatgccagtttctttgagaatatagagaatattctcaggatatagaatggaaaattgaagtcagatctaggacaaaaattccaggacgtaagattgaatttcagggctctaagcaacaagatgcttcatcttctatatgccgtgaatactaccattctctaccagtaatagaaaagacattgtcagcatctgcacccatctctttctgtattttttgagttatctggcatttccatattttgctgacaggccaaggtgaaagtccccatcgtttcatacctggacatccctacattgtaactctgcatgctcctccattccccagtacgttgtctacactgcagccagactgaccttttacaaatgcagaccagattataacacaggctgctgaaaacctttcatatcttactatttttcttaggaaaaagaacagaaatccttaatatggctttaaagtttttatgttttattttctgcttaattctccagccttaaaatattctactctcctctggctgggcagccatggtggcttctgtcatgtcctttaacatggcctgtacccttcttggctctcaccctgcccacagtctccaacacatattcacctttcagagctcagaacataggccatctagaaaaatcctcagttgagtcaggttctgctgttttatattttcaagacattatatacctttccttcaggacacattacagtttataatcatacattcataagtaccatcatttgtttaatctctcccactccctactgtaagctgcatgagagcaagacatttgcctttttttgttatttattctagattgagaactgacacttagtaagcacatgaccaatggctgatgagtgttgctgaatatctgaaaatatgggctcataaaaattctaccaaacccaaatcattatttgaataatttggatactgtagaagcattctgagaagaaataatgccagtagcatgaaatatacttaatgcctatttgaaaaatcttcaggcaacactttcctatttttggtttagattttttaagggaaaattaaagctattacttaagtaattcagatcacggatttttttaaaaagtgccaaattccactttgatgtgagattgataatgacaggtaggagtaaagtgaatttgttctatatgacccgaataattgtgtcagttatccatttaacatgtggttgtccatgtaatggtgtgttggtgtgttggttgctttacacatgcctgaatatttaaggaatcctccagggtgtctgaatgtaattaaagtatgacataagcattttaaaaaaatgaaatgattaaatctctactttctcaatgacctcttccatgttaacaagattacaattagggatgtggaggatctaaagggcctttaagttgaaatctatcaagcttagtagccatgtagcctggctgacgggctgagttgattgttggcttaagttgaacatggcataaggattgtgctctccttttccatagtgctggggttttggaggactttggtgcactgatgccttctgattgccttgttctgcttcctgtcattgttaacatgggcacgaggaagagagagtaactcatatttgaattaaagaccagttcaaaattagaacagatacctattacaaaagatatggccttggggattggtgagagatgcagagatgagggaagcataataccaaaggaaacgaagcatctggagaacccaggaactctttggacaaaagtctttgtatgaaagcagaaactaaacattcgttcaagggcttggatggtccaaagaaataaaacataactacctcgagaaatgagaggaagaaaaaaatgtgataatctctaagtccaggttaaaatatcaaactatgttcgtgtggctcagatgaacgttggagatgaaaaatattttgtcagaagccgatagatgtggaaggttgtggtggtggtgagcttcctttttcagcctagctccttgttcagctaattcagtaaaaactgcttggggcaaagcctaattggcaaaccggaaaattgggcattttgagggcgacttctgattagtctggatctccacaattcaggctctaaagtacttagaaggtgttttttaattctgagtgatgatcaaaggttaccaactgtatgagaattgaagtttactttctaggagttcagtagtaggataaagaaggtgcttaatagagttgcagttagagaaatattagaaggtataattcaagagacaatgaaattgtgtaagtctgacctttggtgttgattcttctctgaaaatggttgcaatcaaaaacagcaaagaagactgtggtggcccaggaagcagaaaattgctggaaaaagaaaaaaaaaattggtatcttgtttgatggcatagacaggagctccatggttttccagtagtctgatgggagagagcattttacttgaaaaaaattgtgaaggctttttaaaggaaaatccccctccagttcactgttttattgaacgaggactttttgagttcctcttatgtcagccagtgtgttggttgctttcacacagatttgctcatgaaactaatttactgcctagcatactctttcattaaaatatcacataaacgtttttaacaagtttaagtttttggcaagcaacttatttgatgacagaggctctatgctgttaggccacggtaaactgttaaatatattaaatgagcactttcatagcagtttactcattcctttattccctgactcagcaaatatttattgaagccaaacgttaagagccaggaagtatttttgacattagaactttcaaagtgattgaaacaagcagagaggggcacttagccaggttgcagataattactttcaggatggttttctacagtaggtgatgcctagggtgggggagtgttggaagtggtctaggaggatggaagagtaaaaggaaggtatgaaaagaggaaacagcaaggggccagccttttgcattccagtatagtgttagtcataggcttcagggctctccttgagagcataggtacttaactttcagagagcttactcctgtcagctgagggcaattctttggagaaggggagctactggaagccttttgcagccaacactcacagaagctgggggtggtgcattggcccagtacaaggtatctgagtggtgcaccaaaacagcgttggccaaccacaagagtgactgggagatgaataataaatatatcaatggtcactcctctttgacaaagcttgaatagggatgtttccccagcaacatccttagccctgtgctcacaactgttatttctctctaagcaaagtccactctcctctgctgcaactcagcaccaccttctgatgtcctcatgactccctcacccatgcatccagccaggctttctccaaataaatgtttgttgaatggataaatatactaggaattctctgactgaagaaggagaaaacataattacaggcacagaaaagagttgttcgaaggcatgttcaaaagctaggacaatgaatttatgtcatagtggaagttcaggtctgttcagaatgaaaaacaagtgaaaatgtgctggttgtatctgataataatgctaaacacattttttttcctaaatcaaaacagttatttttgttcagctcaaaatagactcccaagaatactcccctccttacccattgtttccaagagagaaaatctgacatatttaatcaatggactgaaaatgaagtttccctcttctctcccaggcagtgggctgctgctctttctggatattggggcaagagacaagtcaggcttggaagggtgtcctaatatttgcaaatgtccatttttctgtccaagcacagagaaggtaaagagccaagaggaaatggttaagagggctatcttggcaagccttttactccagaaagaggaaagaatcttcagaaaaaggacaaaagtgcaaaaagatttctctgaaaaaaaaaaaaaaaagaaaaaagggcaatccagcttaaaaaactttgatgataaggaactctctagggatagatagctagcaaaaaacattcgactgagcttcagaaacaagttctctggaaactgaaggacaaaacactggctggacattcctggcagtgagctacggatggcataacatagcaactacatctccttagccatttgttctagtttgctctacattaacaattcacaacaagaagagtggaaagtgttaaggagctaccatttagtgcctctgacacctcagctactatgcaagttgtttcctgtagcctacttcatttgatcctcagactgacttgctatcttctttgtaaaaatgaggaaacgagagctcagagattcaataatttgcccagcttcatatatttattgagtggcatgtgctctcatctatgcttaaatgtaattatgtgtacttaaaggcaaatatcgttctccattttccacatatccaagattttagggatgatagggtttctctgagttatggttggtaataaaaaagaaactttttcgtattagagtagtttgaggatagagcaattatcatgtaaggtatactgctcagagtctatgcccacctcattcaggccactctaacaataaacacaggccttttggcctggcgggctagatagtccctgtgacagccagactcctcatttggttatctgtggagtaggagggaaattaaatatacatctgcatcttttccaacaacaaatcttaagagattattgctagttatagcagcaatggtttctggtatagaagaataaatagaaaacaatgtttggtgtatttgaataattagttctatccttttttctgaaagctttgagagttacttgatttgttttttattcttttgacttgaaattgagaggcatatttctacttttttgattcttaaacatttaagattcttctaccttttatgacatagaggtttaatataattacctaatcatatatttacctgtttaaggtacttcaacagctgttgatgtgatggtttctgtgaattggtagaaagattttggaccagtagtaataacttctcaaaaaccctctgtcttagtttgggctgctataacaaaaatgccttagactgggtaatttatcaatgacagaaatttatttcctgtatttttggaggatggggagtccaaggtcaaggcaccagcagattcagtgtctggtgaggacttgctgtgcttcagagatggtgcctacttgctgcatcctcacatggcagaaggggcaaatgctgtgtcttcacatggtgaaaaggacaaacatgctcccttcaccttcttttatatgggcacaaatctcattcatgaggccctcatgatttaataatttccccaaagatcccacctcttaacactattgcattaagggttcagtttcaacatataaatttggagggacacaaacatttagaccatagcagcctccttattttacttaggagtatatcaagcatactcagcaagagaagctgaagaggatgagagccctctagcttagacatcacaacacctctatgaggccatttttccactcattgctcctttgcaggcgatccttatgatctgggcatccctccccttgagctgactgtggctgtcggaggacgtattgatagtggcttctcctggaccacagcatgactgcacaggtttctccaagactctcgccagggagatccagaggagcaagtttggtctcagggtgccaccagcaggatgtgtggccaccagagcctgcgtttgtgattggggcttattatcctatagtggccccgcagtttctttcaggggagagcctgcttggcccgtgtctctccctgagtgctatacttacctctcatcagctcatttattttccaaatcttctctgaggtgctgttatcttacctagggattgaaaaaaaaacttacttagggagaaaaaagttatattaattctggaaataaaagcattttaaacttcaggcttaaaaattataatttgctgcatatttgaaagtaaaacacatacaacatctaaatgtaaatatatttggtatgactttaatgttatccttcaccaatattctgtatgtaattctgaatatttaggttgccagtgctagcctttccccatttccctgggtgagataattatcatgggaactggaagaaatattatacatggctcttttctctgaagacaaacttcttatcttggcataatcagctcgtgttgatcggacccctacctcactgtttttataatagtctctgttttatgatatagccaatgactcccaggctgtctctgttttctggctctcatctcaccactcctcactagtctggttcaaccttcaggactcaactttgataattcctctcccatgactatatgatatatcctactcttttatttgtttgtttgtttgtttgttttgagacagggtcttgctttgttgcccagactgtagtacagtggcttgatcatggctcactgcagcctcaacctcccaagctcaagcagtcctcccacctcagttttctgagtagctgggaccacaggcatgtgccaccacccctggctaatggttttcttttttgtttttttgtagagacagggtctcttcatattacccaggatggtcttgaactcctgggttccagcgatcttcctacctcagcctcccaaagtgctgggattatatgtgtgaaccctttccagcacacatcccactcttaattcctcattaggtgcttctagtgtacgttactctccattgtgacacccctggtggtagttcttaggcattatgacttgtcaggcacaagtaagaaaaagtcagcactctggtaccaggtactcacaagctacttttgttgttgctgttgttctggcttattcccattccctaatcacaaggctcctcctcagaatgccatcttaccttgctaaatgacggcagagattgatttctagcattgtcatgtcacttgcatgagttgtacttgttatgcgtttcctaggctcaatgtactactagttctgttacatctgtttaggtatttgtttgcatgtgtactgttcattggggctgcactcagcattgatgctgagtacgctaaagatagtaacttagttctaggcttatattgttgattgtcctgatagatgtattggtatgcaattggctggttataaagacattcagagatgtaactatgagcctttgactactacaaggatgaagaacataatggagatataatgctctgtaaacttaagaatggtttgtacatttctaagttggttaatgcagtctttcattggcttattcaacaatcactgggcacattagatgtaccgagcctcttttaagagggagaatgaaagttaaattaatagtttctttcctcaaatatctgggagcctaatggaggaggaggaggacattaagttatttcagtaaggtggagaggcttgattctcattttactatctattctaacacttgtagaaagcatgcttgctcttcagatttaggcttcctgaaatgtagggagggcatgctattggagaattcaggaactagcaatacttagaacaggcattcaggaaagagatttcagtttaggttggagaaagggattgaaaagacttgccagttcccagaattagaaagaccagattaccagtgtattagtaagctattaattgaggcagagacaacaaggcagaggtttacatagacaacctatgcccaaatagtcgggccaaaggcaggagaaacttgttgctgacatcatgtagtatttgacagattataacccgtcacctgtatctttacttataagctgtcataatttagaactcttgcaaaataatttcttaatacattcttaatacattttcaccttaaatttttttttgagttttactatcgttttcaagtagcagcagcaattattgtaatatttactcagtgcttaatcttgggatgagtccccttggggacttatatggcttaatatagtcaaaattacacttttgttaccatgagtgagtaaagacattatctttaaggaagcaacatcatgtaatctgttaatacactgctcttattcaatttataagaccactgtatacaatcaggagacatctaccactacttcataggtatcgcaagacagaaacggacaacgaaatctgaggggtccatagctttatgctagtcatgctagattcactgagattttggcagggcaattgattgattgattaattgatccactctttcctcaattatttattgaatgtcagatatggacattatgtcaggaatatggcttatttttattcaaaagaaggaaaatgtatattcattagtctaatttttatctaataattccatgaagaacaaggtaagttacagtgaaaatgacttattaggattttagagaaatttggggggttgggggtgaatggaaatgtgagaaaaagggagaacagcataccaaaagggtattatggtctcatttgactgaatacttataacagttccacaattgtagaattatgaaatatttatgggtacctattatgtgcaaatcactatattaggtacagaaagcacaaaaacagatttttttttttttttaccgtcaggaaggtttacctctagtgaattgcattaaacatacataaataaatataacatgagatgaagtttgtcaggtgtctaggagatatttgaaagagtacattttcagctctttgggtatttggaggcccaatggagatgtcatttgcactggtccttaattactggataagtttgggatccacagatatagaaagaaagagaattacaagtgaaaggagctgtaagcaaaaccataaagacaataaattaaaggacatgcacagaacacaatttgttccacttggctagagtcgagggaaataaagttcgaaattcaaactggggtcatctttaatgccaggctgaagaatttgacctttatttaataggcaatgaaaaatgttgcttatcaatgtcaacacgtaattcgtggctggattacgcagcaggattttatcaatctatgtcatcatgacctctgaaatccaacctttggtcaggagcatatattgatgtctaagaactttaggattaacttccccagggaaatttatagcacagctttagatttgattctttagagaatttttatttgaggcaatataaaagtctgatgtgtgttgactacaagttttaaaataaatggtggaatgcttttggtttgccaatttctgaaaagtaaaataatgacatattaagtaatggaaatgtgggaattaaaactttcacagaaagagcaaacaaactcatcatttctttccttatctctgtttctgtgtcaggcccccttcctggctcatgtcttgtcctccaagatgtcctcagttgcctctatttcagttcttttttctttccatgaggggtgagacaccattttagaacttagtaagccacgcttggcctcagtgtccgaaaataattggagtaatttcattttgtttcttctagagggggatccagaaggttcagaagttgacctgttctttacttacctttctgtagactttaccttgttccaagtcctgctgggatgatagcctttaatgtatttatcactgtgtggtgctccaataatccaccaattctgcaaatttttgtccttgaatttaggatgcttttacattttttctcggaaaacagttttaccagctggcagtctgagttaactaagttccatatataaatttatgcaggaaggagagggagaagaaaatatgcaggaatgaaaacaaatatttgaatgcagtgtaatagctcaaagcgcgaatccaagataggtcaagttagagtgatttttaaaaagatcttcaaatttcagaatactttatgatattctctgccaaaaactctgggttttcatcagtgtctttcaccattttatggctcttagtggtgttttgtggtccataaatttaatatattgtccatgctacctatcgtataccctgagataaattcccagaccacattggcacactgagagcagcacattaaatgcctctccctgatttttcatgccctttccatccatcaagcaagcctatacaaaataccttttatgtgttaacatgctagatactctatggcaccacttttcagaatttattgtgataaaaatgaactggaggtatattatgatgcagattctgaagtctgggttgggacctgaaggtctgcatttctaatatgctcacagctatgttggtagagggaccacactttgggtggcagggctctttgggattatctttaataaagaactcataatataatggggtcattaggcacatcaaaagcaaatataaggcaatctgaatacagtgatacacatatttcattgagaatagaaaggaagaaaggattcattttgtggagagtaggagaaattcagaaaggtttcatagaagaggaaacttattaaactgggtctaggaagatgtgaaggatctgagcaggcatggaagattttccagatggaaggactacatgtcagaatccatgggctccgtagacccaagtggctgggacttagggtgtacatggaaaagaggttggagataggactgaaaagggagccagcttaattagcttatttcttccaggatacacatgcaaacacattcaggaattttgtgagagatggggggtgaaaattaaataaaacaaacactcaaacacacacatgtgcgtgcacacacacacacacacgatcctggtcaaagttgccatattgcttgctcacaaatcagttttatcttcagaaaaacacagccaattttaacagagaatttttgtccttaagccatgttttaactttataacgtggagtttttaaaggaaatataaatagcacactttggagaactttcatgagtatcactctgaaaaacatacataagctttctaagattcttctagcaagcttcttcaaatctcccctactctcctccctccttagaatgtagttgctttgtaagtgggacctcatgtttacagataaggtctacatttttgggtatggcatgaatagtcctttatgatttggttccaacttatctttctagcctatcgcttactgtatttcccttcaatgctctactttaccatctaagtggaatatttaccttttattaattgaaaaataaattcatggaatgccttctatgtgccagaatatgtgtttgactctagggatatagttttgaacccagcagatgtggaacctgctttaaaggagctcatattctcatggcattgatagatatttacaagtaaatgcaataaattgtgatgagtattataaaagaacaaaaaattatagggatattacttacaatgggaatcagtgtacacattcctgaagaagtgatgtttgagctcctgaaaaataaagggagttatcagagggatggttgatggaagttggggagagatagagagagaacagcacacacaaaatgaagtatcctaggctaatgagaaagtgtggagccttcaaatcttcaaataattgtgacaaattcaatattatttgatataaaagtatgagagagaaatgagagctagaaggggccagttgcagaaggctttgtacactgtgtaatcaacataaacatgctgagggtaatgaaaaccaatgaagggttttaagcagggaacttacataaacaactttacattttgacactatcatacaggctgcaggatggaggatgacttgaaggggatgaaactagaggtgagagatcagctcttgcaattgctcaggtgaaatatgctgatgttttgtatgacagtggtggcagtagaaatggagagtagataatttcacataggaggattttggggagtagtgtggatacaggagacaaagaagtcagtgatgacaccaatatttcaggtttgggcaggtattatttattaagctggggaagcaatgagaaacactgtctctgaggggaagaagataacttcacatttggacacgtgcttgatggtctcttggaatacctaaataaagatgtagagtgggagtgagggatatatgttcagaactaagtggcgaactaagtggggaatttattaatctgggcatcatcaggatacggatgaaatcgaaagccatggaaatatatgtgattgttttgggggagtatgtagagtgagaaggttgaaaggctgaggactgagtcctggagaatatgaacattaggtcatgagcaaaaacaaacaaacaaagcctataaagtggcttgggaatgagctaccaatagcaagaggaaaattcggagagactgagtccttagaaaacaaaggaagagagtatttcaagaaggaaaagtatttctatgggtaaataggtttgagtagccttgagatccacatttgaaaagtgtctgttcttttgagggcttgatttgtcatgggtgatcttggtcaatgttaaaactctttctttctcctgcctttcagcccatgtttatattatattttcaattcctctgtagaattccatccacattttaagatttagttaaagttgaatctgctttataaaaatctttttgatcctccattcagagacacattctcacttttatgttcatctgtcattttatacaccttatatgatctttgtaacaggctacctttcctttcatcatttgggcatacatatcctaataatccagaaagttttttaggtacagaaactctgccttgaatgggaagataatagctcaaattatgaggatcgcacaactggtcacatagagttattatttatctttgcagaattttaagacacccaacctaataatgtagtccagggctctgggaaggcaggaattgtgtttcatttctgtaaattgttttatcctcattgcttagcccatgatatatatgaaactcctgttaaaaatgttcttgcatattttctttcacattttattttttctctgttgaaaaagtgatttcaattatgttcctattggacattttagtatttttgacaaattctaggttgtgtcatggcattattatttcattatcttcacaactttcattaaacatacttttttttttatcaaagtccccagtaagcaataatagagctgatgtggacatttgtatccattgaactagtctgcaagtggaatgacatcgttacacactggtattccctttttccagtaacactttgaatgagagccacttgagccatggtggtacttacgtgggttttgcttgtcacagtcccatcatggtttcagatgtcaccaacagctcctttaatgcctttattaatgtttgatcacttaggttctatcttactttcacttctttaatccatagtttgaaagcaagagcatttaaattaattattcccttctcaacatggagcttctctcaatgcggaaataagggtagacactgaggctggacacagtagctcacacttgtaatcctagcactttgggaggccaaggcaggtggatcaggtggatcatgaggtcaggagattaaaactatcctggccaatatggtgaaaccccgtctctactaaaaaaaaaatacaaaaattagctgggcgtggtggtgcttgcctgtagtcccagctactcgggaggctgaggcagaagaatcacttgaacccaggaagcagaggttgcagtgagtcgaaattgcaccactgcactccagcctggacagggcaagactccgtctcaaaaaaaaaaaaaaaaaaaaaagagtgggcgctgatgctctccctggcctccgttttaagttctgaaagcaattcaaagagaaagaggcaggtaggtcatcagctttctggaagaggttatactctatctcaaacatgcatccacttgctctttatgttcttataaggactcaggtacaaattagggaaaataaatgccagctgaggtttccttcctttgtaccccatccagggaaagagatctaacagtatcccaggaaagctttccataaacatcgtcctttttaattcagccagagttacatccagaaaaacaaccacttgaaaccctttgcccctattttcagattgctgccaaagcttttgccttagcttacttcaacaagaataaactgtacgaaagctctggagttctcagagaatgtgactgcctgccctgcttgtttaaggtcattaaaatcctggcctttgccaaaagacttagagcacagccattgtgttcttggagtgaactgtaattttgcttaggtcacagacattttagtggccaacaatattaagatgggtactttttaatggtgttaagtataaatgaaatgcaaagggtgagtacgataattacaaaattgtgtttatcgtgaagatagtctgtataagaaattgctaggacatttacattcattaattattgaaaatgaaacagccttcctattattctgtcagataaagaactctatattccaaatgccaatttcttagagattttattttctttattgggtcctaaaagctcttcatatttatcctgggtgcatttgcggccatgtacatatagccaaaaatatgtgatgagttgtataattatctggtgaatccaagcctagcaggacaacctgttaaagagataaaagcaaaactactttcaagtcatcattgcttggttattttgaactgaaatgtccagtagatcttccatttgctttggttaagaaaaaaaagaagctcatttttttcttcttatatgagttattttctctataatgaactacaaaaattgcattcatatatttgctttttgaatattacctgtattattaatgtgactgattagagaaaaatagaatagattgtggtccattttttttttagtattatgcttaagtacaaaagttgagaaaacatttcatggggttttttttggtaagcaaaagacaagctgatgtaatacatttgtgtttgaataattccgcatcaatatacatgaacctgtttatcctcatcccttccaaacagattgtaatagaaaaataagatacttgtaggttatatccaactatttaaagtatgcttttaagtcaaatgtacattaataatatttagagggtgaacacaggcatgttttgggtatgctcaatggtgggatatattgtctcagcccaggggaggaagatgggggccttgtgcagatgcctgggcccagaaggcattgagtgctgctggtgaggcagtacaggggcagaaaacgtagcagtggtggtggtgtgggtgactggtggtgtactatgtacttagaacctttcagatgttctattcatattatattatttaatcctcccatttatatgggaggttttattacctccattttaaatatgaaggctctgaaggtcattaaacttgctcaggattgcaaattggtaagttgctgttggaatttgcatgctattttttttctaattccacagttcaaatttgtcatgctagttttagatcacagtggttaatgtgcgcggtttccaaggattgggatacttcaagaagatgtcatttttaagttctgaagaactttaggaagattataggaagcttgctttatatgtgtaattaacctattgggacatatactaactcttgggcatttcatggaacaaattatttgttgagtactgagtgccaggaattgttgtagatgctaaagaagaaacagtgaaccaaacagctgcttcccaacaactctgataaggatagtctcagcagtactgacttaagaagttggtatatttgagattactgttaatgattttaaggttgcaacaaaatttaaaaacatatcagtgacattttatatatttgctaactgttgggaaattgcagttgaatacaagcagcagagtctttagaaggcagtaccaccaagaattagttattgtgtctttcaagcttatttgtgaatccagttcatttaactagatgactatcgacttattaaaaatgcataccctttgtgtgttccatagtgtgtctctgaaattgtacaggttaaacaacctgatgctcacatcaaatagcatggttcccatcatctacttgggtttcattgcgtgtccagcatgggtagcatttgttcctcaaattctaattgtgcttttcatttccagctaccagcactggatagttttatcagacaggtagaaatagttttgaatacacctagccagattcccatgcatggcaggtcacattcaccttccttctgcacttccattccctccaacaattggcaaaattacattcgtatgagttaccttacacattttcagatagacacatatgtctgctgtctctctgggagcattctaaattttgtcagagcagtgcttgggcaaaaagaatccacaggtaggaatatccaataatctgctcactcccaacctggttgccttcaaaaggcgaattattcttgtgcattcagtaatggtttttactaccagctctgccctgaacaactgattcagaattccgtaatttctttcttaagcatggtagtaaatgtggtttcttggacttcttcacatgtacttagcaatttgaacctcagtagaattaaaaaaaaaattctttaaagaccagaaatttgaaagaattaacaattccaggaggcagagtaaaaaaaggattggtaagggaaaagatgaatttgtttttgctggtgtttccagaagtccggaggtatattttcgttctcgtggttttacctttcagccctttctctaagtctgtcagctaacaaaatgcctgcagtcccaaaatgttttattctctagtaaagaaagaagtatcaaattattctaagcatcactgtttatttactataatcccagtaaatctaagttgagataatgagataatgccatctagaagaaaaattaaaaaatattagaagcattttttttaaactttagagataagtagcaaagtttcccttgtacggacagctctcttaaattcctacccttccctaatgctaataagcaatatataatacagttgagcaaacagacattcaccactctttttatcatttaaatggcctcttttagttaacaacaagaaaaaataacagaaaagcccttttaaattctttctataaggaaaacactttcattagaacagacttttatcacagaactagatcattctggggattgcttggtggtaagcttctttcttacttttgtatcctcagtgcttaacatcccctgagatgtaattctcctttgttgttttcctgcataaatatttcttatgattacatattgcccagtcagtgaagtccgaactcactagtatgagatgtaaaaggccatgagctggcactttattcctcctcagtgtcttttctctctactttcccctccatatgtcacattgtgcatttttaggaagaacaaaatatagtcatgagccacataatgacgtttcagtcaataatgtcaataacatacgcgacagtggtcctgtaagattataataccgtatttttgctgtactttttcaatatttagacatgtttggatacacagatacttaccactgtgttacaattgcctacagtattagtatagtaacatgctgtacaggtttgtggcctgagagcaataggctacaccatctagcctcagtgtgtagcaggttacaccatctaggtttgtggaagtacactctatgatgttcgcacaatgacaaaatcacctatcaatgcatttctcagaaaatatccgtttcgttaagtggtgcatgattgtagtgagtttttttttccttttgtgaaacataggtgccctgtagaaaaaccacttgtcaccgggcacagtggctcacgcctacaatcctagcactttggggggctgaggcaggtgaattacttgagctcaggagttcaagaccagcctgggaaacatggcaaaaccctgtctctacaataaataaataaattagccgggcatggtggtgcatgcctgtggtcccagctacttgggtggctgaggttggagtatcatttgagcccaggaggttgaggctgcagtgagctataatcatgccactccactctagcctgggcaagagaacaagaccctggctcaaaaataaaataaaataaaataaaaaataaaaaacaaaagcaaactaacaaaccaaaagaaaccaaccacttgtcttggagccctgtcccttcattttagatgctttatttatagaagtaacaagttggaattgattctcctgaagagttatttatgagaagttttttttccagtagcatctagacttgcattttcagcacatttttatattgtttagctaagtaagaagaaatgtactatggggtggaaaatttagatggattaccactcaagatatcaaagtatagtcataaacttagtttcaaagttggggaaaaaggtgaccttggtaaataaaaaagtgaattccagtcaaggaagcaccatcgagttcatagaagattaaatcttttctttcttttttttttttttgagacggagttttgctcttgttgcctaggctggagtgcaatggcacgatcttggctcaccacaacctccgcctcccaggttcaagcaattctcctgcctcagcctcatgagtagctgggactacaggcatgtgccaccacacccagctaattttgtatttttagtagagatggggtttctctatgttggtcaggctggtcacgaactcccaacctcaggtgatctgcctgctttggcctcccaaagtactgggattaccggcgcgagccactgcgcccggcctagaagattaaatctgagatctgattactaatgagatctgatctcacctggaacatagtgactgctaatgcttatgaattgacttgaaacttaaagcccaaacgggtttactggtagcagaattatctagaaagagcaaagccatggagctattccattaatcagacccatgtctactgcttgatgtcagggcaacatgtatctctcaaatttatctgttaccaaactgtgccatctaatggtcagcttcctctatctgatttgcctgagaaaatcgtccttttaatcttgaatgatttttacaacctaagcctatgttttttgtggagtaggtcctggtttttactacctcctgatatttttttcatcaatgacccctattaggaaactatgtatttatttgtttatagtcaacaaatatttaatgagcacctacttatttgcaaagctttgtgctaatcactggggatacaaaagctattaagagtggcagggtctttgcccctctgcaactgagtctagtgggaatacaaacaggtaagtagtgcctaaaatacagtgtgattaataccatgataagggaagtacagaatgtctcttctccattcacagaagagggcacctcacccaggaatggggatccagggaagacttcctagaggaagtaagagactttcattcaagtctttataagagttctctggctgcagtgtgaagagtggcttggtgaagaaatgatggccacctaaatatgaaagtagagaaaacaggaaagttttaagacacaggagttataatccatactggtgtttgatttgatgtaagcagtgaaggagaaggtattcttgggaatgatgctcagctttatggtttgggaaactgactggatagtagtgacattgacagagagagcaaatgcagggtgtgacagtgaggagatgatgagttcagtttaggacatggtaattcaagttagctgtgggagaaacaaaaagatatgttttatagactggtgggcattcacatataacactggatatttaaaaattactatgagccccaggcaaagtggctaatgcctgtaatcccaatacttaggggagtcaaagcagatggatagatcacttgagcctaggagttcgatatcagacctggcaaccctgtaagaccctttctatatgaaaattaaaaaaattatctgggtgtgctggtacattcctgaatccccagctccccaggaggctgaggtgggagaattgcttgagcctgggaggtacaggctgtagtgagctttggtcaagccactgaacttcagtctgggtaacagagtgaaaccctgtctcaaataaataaataaataaataaatattatcaataaatagatcataatcaaatcatataaatcaatagtggtggacctcagaattctaccagctatttgggccagtacccaggtgtcttatcagtctgtgtgcaggaggcacaaaagttcacctaaccttattcacaaattttcaccttaaatggagtttgaaggaacctgttagtcttaggcctttctgcatatatgcatatatatgcaatatatggcctttctgtctcttacatatacacacatggtatttcagcaaagaggtgatatggcattacagagaggttgcaggacaagaggacagaaacacccaggttttaggcaaaagctatgttgctttccaatatttgactctggttcagtctccagttgctttaactgtgaaatggagatgacgaaatggctcttcttacaaggtggtttgaggctcaaataagtgatgtattacaaactataatatgttacacaaatgcaaagcattgcaattagctccttcttggcaataaacaaataaaaaatggaaaaaccaagctgtaagtttctggaaaacatttctctcttataagttttttcattcagatttattgaaaaaatgttttaagcatttagtcctaagaacacattgtttagaactgaaaaactgaaattggaaatcatatagccttttagaattctaagttagcaacctgaagcatttggactattatttgtttcttatttgttgcgggaagtcagggacccagaatggagggaccggctgaagctgtggcagaagaacatgaattgtgaagatttcatggacatttatcagttcccaaaattaatacttttataattccttatgcctgtctttactgcaatctctgaacataaattgtgaatatttcagggacatttatcacttccccaatcaatattcttataatttcttatgcttgtctttactttaatctcttaatcctgttatctttgcaagctgagaatgtatgtcacctcaagaccactattgtacaaattgattgtaaaatatgtgtgtttgaacaatatgaaatcagtgcaccctaaaaaagaacagaataacaatgattttcagggaataaggaaagataaccataatgtctgactgccttcaggtttgggcagaatagagccatatttttcttctcccagaaagctatagacagatatgtgagtaggagaaatatcactgaattcttttcccagcaaggaatattaataattgataccctgggtaaggaatgcattcctggggggaggtctatgaatggctgctctgggagtgtctgtcttctgtggttgagataaggactgaaatatgccctggtctcctgcagtaccctcagcttactagggttgggaaattccagcctggtgaattctagtcagaatggttgtctgctctcgaactctgtttcctgttaagatgtttatcatgacaatgtgtgcacagcaggacatggaccctcatcagtaattctaattttgcctttgtcttgtgatcttttattgccccttgaagcatgtgatctttgtgacttactccctgttcgtacacccactccccagcaaaaacttgctggttttgcagctcaaggtcgccatcacggtcctaccaatatgtgatgacacccccggaggcccagctgtaaaatttctctctttgtactctttctctttatatctcagactggccgacacttagggaaaatagaaagaacctacattgaaatattgggggctggttcccccgatacgtattattttcttatatttcattgggtaagtgaactaaggaatactgcaaggaagacaatacttttgaatcgtctctatgtgcctgatagatcatatctaagtgtttaaaaaagataatataaggaaaacaatcactgtgtcaacatgaagatttgattatgcctttctttctatgacctgttttcatgaacattcaattttccttggcctcttaggaaagaaaggacacacactggcacactatagtggggacatctggatctctgaaattgtctagcaaagagaggtcactgagcacccatatgaataggagacagaagtcagagacagaggcaaaaaaaaaaattagaataggagacacagggtagtaaactgatgtttgtggcttagctcgatttttggtaatttaaaagataatgttgataatatgattgatacggacttttaagaaagagaagaaataaataaataaatctcatgagagacacagatgcaggtgtcttgaaccactttatagagttgtgagtatgtggtctgaaatattttatgaaaatgacgccttggatacatttttttcttgtcagttccttcggttttgcatttttgtgtgtgtgatttagtgctattaaaatagtttaaaaaataatgctcagagttgatcatgcaatttaaaaattaaatagaatagagaggaagacagttctaaaaaggaaatctgaggggtatgagataaaaacgtgttgatcatggtctttcaaacatgaatgtgaatatgaatatatttacatatatacctacatatatatatatgcacatataaaagtttattgttcttaggcactctgattatatcacaaatactttaattttatgcatttggttttcaaaatatcttttacaattcatttttaaatattttgtgtttacaaaatgcctatgtgtaaaaaatctacacttttacctatttagtgtcactgtgaattactcactatatgtttctcatgggtagtttgaagagtttagagaagtgcatgtttgaacatcatggaaaagtaatatttaagttcaggtggttgttgggttctggcaatatttatgtaatattttatattttttttcaaagaactctacatctatataaatgtccagatagtcaccaacatttggctctaaccttcattatgcttgcttttattattcctataaagtgtccttctactgagtgtgtatatttgaaatatgatttgaaatttttagtatgatttaatgctaaaccttgcaattaatttcatttatgattttaaagcatttcttcagttaaatctgtggttttatatttattagtgaaatttcctcccagatttgttaagatataacttacacacaataatataagcatacagtctgatgaacttttgcaattgtatgcaactgtataactaccaccacaatcaggatatgtaaaggcagacaatttcatcacccctttcagtctgtctcctcctcaatgttgtttgccttttctggaatttcgtataaataaaattatacagtatgtagtcttttgtgtttgacttttttcacttaacgtaaggttttttgaggttcactcatgttgtgtgtatcaatagtttgttcatttcatttttatagggagatagtattccaatagtatagatataccacaatcattttatccattcattagttgatgtaaatttaatgtttttattttcagtgtttagctatcttgaataatgctgctatggccattctcatatgaatgtttttgtggacatattttttcatgtctctggggtgaaaacttaggaatggaatttctgtgtggtgcgatagatgagtatggtgtggtaggcacaccaccaacctgtcctccaagtggctggatgattttacactccaccagaaatgcatgaaagttccagtagttccatgccctcatcaatagtacctgttggtgaattttggtcattccagtgggtttttagtgaagttttaagtcacaggttaacatgtgactgaaaatatttctctactaaaagacaaaatgaaggtgcattttatttcaggctctcagtctggtcagccaccagcatggactcggaatgcataagccctggttttattgaactgaaatatttttcttttcataaagtgaaatattaaagtgtgttggtttcagtttgataattcaaatactgccattttaatggcttccatcataaatctattttattgcactctgtgtcatctctcatatcttggataaaaatgcttttgtttcctttctggttaatagacttggaaatcatctgtgtatacgtttgtttctttcctttttgtgattggagtgagttagtaataaattcttttttttttctcatttttttttccttagcatgctttcaattctgtgttacataaggccaccatagccgttgggaactggttgtttttaatgatgattattttaatgatgtctgttatattgtaagttgtcaaattattgacaatttttgaatattgtcaaaaacctctattctctttaagaatatttatttctctttggagttccactatattgcaaggtgaatgaatgtgtttgacaggtaatggttagaagtctgtatgaaattcttctgtgagtaaaagtagctattatcactgagtatgaatatatgattttggagtgtttttgtttgtaataaaatagtataacatttataacatattttcttgctttttattaaagaatcttaaaactatggaaaatgcagttctacaaggagtctacaatttagtggagaagacaaaaaacaaaaaacaaaaatttagtaattcaagttggtgtatggtatggagaaattatttctccccagtcctgatttttttcttccatgtgaaaggagcttagtattcttggccagagaacttcctttttatcctctgcaagaacacagagtaaactactttgctggtaggcatttgttagtggcccacatttcttaattagttgaagtgaaaatacacagggtctgagtctggtcactctgctctttctgaaccagcgagaagcacagaccttggtatgtgaaatcaaagtgtggactcaaactttcttttaggtggctatttcagggtttaataagagggaagaaaggtagcaagcctatctaggcttttgtactgaactgtgtcttctctctggcattcactggcaatgatggtgatattttggtttcaattgctgactgtctcgccttatttctcagtcgacttagaacccatttgaggaacaggctggtatttactggaacccctgaaaggctccagcaagagttatatcaacataggctatagcctcagtgtcatctctgattagttgctaaaatatttcacattacagactgtctcctgcactggattgtcagtatttaaggctgtcttactcaaagtatttgatagtcctgcctgtgggagcacactgccttttgcactgttaggtttgaatgtggccatatgacttactctggccagtgaaatataagtggacgtgacacataatatttctggttggagccagtgatactctctttttctcacttctgcagtgatgaaaacacatttttaaaagggagcctgtatcagtctaggctctggagtgaagaccatgtggaccaaatccctttgcaaattggcattgaacatgtggcacatatgagaactaatttattacctcaaattattgagattttggggttgtttttagcatagtgtatatcttattctgactcagacagagttacttattccttgaaaaatgatttaatggttaaatatatcatgacctttgatataaatgtgatatctcacaattttaaaaatagggttctctggggtgggtggagacgggaaggtattctgcattaaatgtgcttatcacataacacatatctatttctgaaaagtcaaataggctattcatacttgtgcatatcagattcctatcaaattacccagtagagatcagaattttatgtgaactggccaccaacaagtatgctttgatgatggagtgagcagaagaaactaaagctgggaggaagtgggtagctgactgcagcagaactgttagcagaatttaaattgggctcctgagtgattggctgcttcaaaacaataagggaactgcatacaatttagttagcatgccataacaaattccacttgattagtagaattcacaattcatagtgatatttatccttaccttattctgtctctttagctatacctaaacttttttttcccccttttccctattttcttctgcttcttttcacaaacacaaatgctggccacattagaattagcaagacatttgtccaaagacagaaagtttcaccaatattttataagtggcaaagttttccagttttcttttaattctatcctcttatcatcaccatgtcaaaccataatgcaaagtgggcagaaattgagctttctgatgtttattttgccaagagatttgcctcattatttggtgttacaggatttattacttcaccagctagtttaatagtttcaaaatgaatctgtagatgtgctcattgaagagatgctactttttatcagacatacataattttttttaagctttctgttttcattttcataatattctaatccctggccatgagatttcagtgggggtgtttgagtttatccatttattagtgtcatgctaatcaaagattaaatgacatgccctgcaatgtaaataaaagttctaactgtgcttctgttgaaaggtaaactgatgtaagaattgagtgttttatagcacatagtggtacagccaggttgaactcagagtagctgtgttcaaaccaatgggaccacacctgaaggacagatcattacatgaaatacatatgaaattggtctcagtctgaaacaaattgcaacatttcaatagaagtaaatacaatggcaagtataaaataaagtatttttttgattccccattcaagcagtaattaaattacatgtacccataatgtacattcccataatgttacagtatgaatatatactttgaatgcttcaaataagcatgacagatatagaattatgaagaaattgttgatttaaatagatttttcaagatggttttctcagcaggttaggagttatatttgagctctgcttatcactaactactaaaaaaagccaaatatttaataatatagtcttacatatgcaaatagaggcacctcaggaccagtttttgtaaattgtagacacccctacctccactaggaaaggctatgggtggagagagcatttctactgagagaatcgtatttggggtctacagaagagcagtagagatatgcttttttcttcattttcagttagaggagtttcaaggaaaaggtttggagaacttgacatgtgcccctcagttttgaggtctcagtgggctggcattctgttcttcttctcatgaggaatctacaaaggagactatgactgactggctgcttagattatggagggaaggaggcagggtgtactgtttgcactcagacaaaagatacatgggtgtttccattgatcagatggggactgatatgatttggctgtatccccacccaaatctcaccttgaattatatctcccggaactcccccgtgttgtgggagggacctaggatgaggtaattggatcatgggggtgcatctttcccatgctattctcatggtagtgaataagtcttatgagatttgatgggcttatcaagggtttctgcttttgcttcttgctcattttctcttgccgctgttatgtaaggagtacattttgcgtcctgccatgattctgagacctccccagccatgtggaagtgtaagtccaattaaaccatttttcttcccagtcttgagtatgtctttattagcagtgtgaaaatgggctaatatagtaaattggtatcaggagtagggtgttcctgagaagatacccgaaaatgtggaagcgactttggaactgggtaacgggcagaggttgaacagtttggagggctcagaagaagacaggaaaatgtgggaaagtttggaacttcctagagacttgttgaatggctttgaccaaaagcctgatagtaatatggaaaataaggcccaggctgagaaggtctcagatggagatgaggaacttgttggcaactggagcaaaggtggctcttgttatgttttagcaaagagactggtggcattttgcccccaccctagagatttgtggaactttgagcttgagagagatgatttagggtatctggtgaaagaaatctctaagcagtagagcattcaagaggtgactttggtgctgttaaaagcattccattttaaaagaaaaacagagcataggagtttggaaaatttgcagcctgatgatgcaatagaaaagaaaaacccattttttgaggagaaaatcaagctggctgcagcaatttgcataactaacaaggagccgaatgttaatccacaagacaatgggaaaaatgtctccagggcatgtcataggtcttcatggcagtccctcccatcatggacccagaagcctaggaggtaaaaatggttttggggacctggcccagggtccccatgctgtgtgcagcctagggacttagtgccctgtgtcccacctgctccagccattgctaaaaggggccaaggtacagctcggccatggtttcagaggatccaagccctaaaccttggcagcttccacatggtgttgagactgtgcatgtgctgaagaattgaggtttcataatctccacctagatttcagaagatgtatggaaatgcttggatgcccaggcaaaagtttgctgcaggggtggggcccttatggagaccctctgctagggcagtgcagaaggaaaatgtggggttggatcccccccaaacacacatagcatccatactagggcatcatctagtgaagctgtgagaagagggccaccatccttcagaccccagaatggtagatccactgacagcttgcaccgtgcacctggaaaagccacagacactcaacatcagactatgaaagcagccaggagggggcctataccctgcaaagcaacaggggcagagctgcctaagattataggaaccttcctcttgcatcagcatgacctggatgtaagacatggggtcaaaggagatcattttggaccttaaaatttgactaccccactggattttgaacttgcgtgggccctgtaacccctttgttttggccaatctctcccatttggaatggctgtatttacctgatacctgtatcttcattgtatctaggaagtaactagcttgcttttgattttacaggctcataggcagaagcgacctgccttgtctcagatgagactttggactgtggacttttgggttaatgctgaaatgagttaagactttgggggactgttgggaaggcatgattggttttgaaatgtgagggcatgagatttggaggggccaggggtgtaattacatagtttggctgtgtccccacccaaatctctacttgaattgtagctcccagaattcccctgtgttgtgggagggacacagtatgaggtaattgaatcatgggggccagtctttcctgtactattcttgtgatagtgaataagtctcacgagatctgatgggtttatcatgggtttcctctagcttcttgctcattttcttttgctgctgccatgtaagaagtacctttcacctcctgccatgattctgaggcctccccagacatgtggaactgtaagtccaattaaaccattttttcttcccagtcttgggtatgtctttatcagcagtgtgaaaatggactaacacagggccatgtgatagagttggaccaggagattgtctttgaacctgctcaggagggtatcctggagaggcaaggtgactgtaccagagaggactgcccacttctgagctgagggagaatatataagcaaatggtggaaagatacatttacccaagtcaaggaaactatttgtagcttttcagggacaaaagaaggaatgtttagggacagtcaagaagggagtcagtactaaacacctgataatcctagagaaaagtagtgccagctgaagatagaaacaataaagtaacattttccttccttcatacctagaggcatagaacagaataagtagaggaggaggacatgagtgccttggtgctcatctatagggtactgcaaagatgcaagtctgcaaactcgtacaaacactgcagcatacagggagagtactcattacccaggcagtggttaccctttctatgctgctgccttcttctcatcttcttttcccctagccacagctggaagtggtgggcaggaaggagctatcagaataaagataacagaatccaagcaccctctttccacagttgccagcttcccactgcagcagcaccagtctggggagtgaggatggggaggagaagaaagtcatctgtaaatgaagtttagagttttgtttattacaataaaccacttcatcattcccctataacttttcagtgactcctcattcctcacacagtaaaagccagcattcttttttatgacctgcaaggctgctactcaaagagtgggccatggactggcagcatcagcactgcccaggagtctattagaaatgccaaatctccagacccatcctagacccactgttttaatccgttttcacactgctgacaaagacaaacctgagactgggcaatttacaaaccaaagaggtttgatggacttacaactccacatggctggggaggcctcacaatcattgcggaaggtgaaaggcatgtctcacatggcagcagacaagagaggagatcttgcccagggaaacttccctttataaaaccatcagatcttgtgagacttttcactatcatgagaacagcaagagaaagacttgcccccatgattcaattacttcccaccgggactctcccacaacatgtaggaattgtgggagttacaattcaaagtgagatttgggtggggatacagccaaaccatatcacccactgaatcagaatctgcattttcacaagatccctaggtgattcacatgttcactaaaatttgagaaactccatgacctatgaacttctacccctggttctctttttggctcacatagtaattttctcagttttcctactccaatcatgttatttcctgaacatactaggtggattcttgcctgagggccttagctctgactattccttctcttttgaacaccatttttcaaatacctatatactcactccctttcatctttgtctttaatcttctcagtgagaccaatacacaattaagcttgcatttagaatttcatctccatctgccagcattcccttcctctgccctgacttttttcattcacatatagcaccttttaatgtactgtagaacttgctttttattatgtttattgtctgtctttcctgagaatgtatgctccaccaaagcagggattgttgtcttgtctgctttgcctgctgatgtttctttctctcgctctctttttttttttttctttttgagatgcagtctctgtctgtcgcccaggctggagtgcaatggcgtgatcttggctcactgcaacctccacctcccagcttcaagcaattctcctgcctcagcctccagagtagctgggatgtgcccaccaccacacccggctaatttttgtatttttagtagaaatgaggtttcaccatgttggctaggctggtctcgaactcctgacctcaagtgatctgcccacgtcagcttcccaagtgttgggattacaagtgtgaaccactgtgcctggccctgttgatgttccttgagtttgcagaataatgcctgacacacagtaggtgctcaataactatatcttgattttttttcaaattatcaatttctctaagcacttaatgtgattaaaggcaaacagaatctctgtaaagcatcttattttattggcatacatgtttgcaccaagaaggccactggacaaagtaggcaagttgttttaactggagaatatgggcttttactcatcttcacaattttgatgaaggaagctttatttaaaacaatttaataaattctttcatacttacccaaatgagcttctctcctgagagactgagaaaacacaaagagatttatctaacaaaattttatcaggactagtgtctgaaagttatgcgcactgttttctttttccccaaagaaactaacctgaacttttttatgtttctatccaaatttgaatgttttgttgtacaagctcacttgttcttggacaatgaacctgtttctaagaaaggctaaatatgctcataaagaagactcaacgggcttcttggacaacaaataatttttacaaaacagcactttgatgagtaaagtgtaagtaaatcagaaacagatggaatacatagttactgagactcacaagtttgaaaaacaagtgaaaatttctcatgttttgtgtcctcaaatataaaaataaagtgtatagttgaaacaaaacttttctaatttctaccatgttttgactttaagatcgtgtttcctacatgcttattttttattttagagatggagtctcatttttttgctgaagctggagggcaataatataatcgcagctcactgtagccttgaactcctgggctcaagtgattctctcacctcagcctgccaagcagctaggaatacaggcacataccactgcacctggctaacttttagaaagaatgtctcgtagatatgggatctcactatgttgcccaggctggtctcaaactcctggcttcaagtgatgctgccattttggcctcctaaagtggtgggactacaggtgtgagtgtccatgctggccaaccatgtgcttttctgataggaagtattttctatttatgaacttcctctttatagcacttacaggtaattgaattgttctaatttctcaattttgaaccaagctaaatatattattaatgtacttaggacagtctaaagttattcatattttcttctattttaatatgaggaatggcacaatttttgttttttgttttgtttcagttagtgttcttttggtcataagaaacagagatatgcatagattagtttaagaaatgattattctgcaaatatacaaggacatgaagaaatccatgcacctgagtatggttctaacatgagcatctgcacaacagagcatcatggcaaatggaattgggaagccactagaaatggctaatggctgatctttttcatgaagttttgctcatggctcttctcggctcacctgaaccatttttcctcactttgctgattactgaccttataaattcagcttcaaatgacctacagtggacctggactgagcttactttattatttattaactcagctgccctagcagtctgacttagactcttcagtttcaaattcctgaaagaagactctggcccagctcattttttgaactaggtcactgaccactcaaacctatgactagactatctggtgcaatcatctgtggttgaggcagccaggtttctgcgcaagagagaggtgtgtaaacaggtggaaattcgggtggttcaggcttcagtgtgctaaacacatactccaggattcaccagttgaaagaaaattaccagtaaaatatttttgccaggatattccttggaaaataaaatattacttgtttctcttttcaagaattgaaatgctttagattttaaatttaggatgccaagattggaaagggtgtagaggactttcaaagttcaaaattttgtctaatctgtctggattttgagaaaacaacaacatcatcaattacatgagcgttcaagggatgtgcctttggagatagtttattgtattatttcaaatatagtcactctctttatcttcctaagagccctgaaatattccataaaaaagtaatcttgctttcatacacgctgatcttataaaaggctttatgtttaaaaaaaataacagacttggggaaattggaggagatccgatgaaaacctgataacagttggaataaactttatttttcctggagaaggcagaggagataataaataataattttaaataatatataattctgatgtaggatttagacaaaaatctgctctgtcagcaactggagtttagaaaaccctcaaaagggagataataactacaactgaaagaacagcaagtgaaacaggacctgacttccagccttggctttgccagttaccagctgggctaccttggttacctggtgacatgaaaaaacttggactggatgccagcttaggtccttttttttttttttttttcgagacagagtctcactctgttgcccaggctggtgtgcttatggtgcggtcttgactcactgcaacctccacctcccaggttcaagcgattctcctgcctcagcctcccgagtagctgggattagaggcacatgctaccagactcagctaatttttgtatttttagtagagatggggtttcaatatgttggccaggctggtcttgaactcctgacctcctgatccgcccacctcagtctcccacagtgctgggattacaggcgtgagtcactgtgcctggcctggtccttcttaacattaaagataaatctaaaaaagagacttccagggccactgggcatggctgtacaagaggttcattgcacatttctaaggtgtgacattctgaggattcttatttttatgtggaattttataaagagtaatgatttcttccacatgttgtattatgtttggctcagaatttaaagctcaatcacccatgcaatggcattcatctgaaccaagaaaaagcaaggggaaatcggatgcaggtgacaaggtttgagcttgtgactgagaaacagagctaggtatatttttatgtccccttgaaagaaaaatagactcaaagcatccctatgttgtatgggaactactatcattcaaaaagagatacaaatcactatgtctgattcgttgctaattattgaaaaacgatatatctagacttgagactaattgtaagaaaaaaatcggcaaacattaccagtgacaaaaatataggtttatctatcatagcactaaatggatataactctaaaatacacaggttaaaaattttaccctacctttaggcatagttattccaattcattcaaagaaaaacaggccactttctcacagcaaatcgagcattatgagagtatcacggttttgaaacaagagttccctgaaagcagggctcttagaatctagattataatatcaaaggctttttcaatggtcagaagttgacttgaatagacattttctctcccacaataatgtcaaccacaggcatcgcttcacttttgtaaatgtattcattgaatatttgcctatttatatattccaaggacattgtaaaatttcagcctctagaagaagagtggatccagccttccgcataagaagtaggattctaatgagaacacatggacacagggaggcgaacatcacatactggggcctgctgaggggtggggggcaaggggagggagagcattaggtcaaatacctagtgcatgcggggcttaaaacccagatgacaggttgacatggcacatgtatacatatgtaacaaacctgcacattctgcatatgtatcccagaacttaaaataaaagaaaaaaaagaagttgcgttctgtaaggtataatttgagggcctaagaagccagactattttccatgtccaaggataattgctatttaagttaagaatttttctgtttccacttatagggtggaaaacaccttaatatcttgtaagaatgagcttattatagcggttttctttaatgataggaggggcttatgtgggcacttttggttcctaagcagttggtgtaaaaatgagaaggcactgaaaatacatttttctcctagaaatgactcatttgtgtgtgtgtgtgtgtgtgtgtgtgtgtgtgtgtggtataattttatgattttatatattatacagtattttaaaaaacagatactttttaaagatgcatgatagtatcatacttttattatgctaatccccaatgtgataaccaagatgatataataacacaaaattgcatcttattttaatcttgaattaataaataaactataaaataagataatctatgtttgttgaccataaaatcccgaagtccattagcattacttattcataaagagtattggtaatatgaagtaccaatatgatgaatacattctttgaaaaagtgaaagtgaacagaagatgtaaattacactgactttttttgcccaggggaaaaaaagagcatcatgccacagctggagtaatgacaaagtttattgggttacactggataataattctctgactttgattctttgatatacatgccagggagattaaaaggaggcctgtgacttgtttaagaacaccgtgttttgaattgtttgctgtagtttttacctatcccaaatttgtaagtctatggatattaaaactaaaatagaattcatggttgctcttagggaatattggctgagccaggttgcaagtatggatcagcttgagatagttagctttgcaaaggagagaaaagataagtcacttgcagtctgttttccctgtctttcaaaactatttgttcaaaactaaatcccaaactgctcctttgtaaacacagccaatggggcttcctaactctcatgaagtaaatagtttcagctttacaaaattgcagaatctcaggaggctaagaataatctagtgaacttgatcttatctaatgtattcagtgttctttgaaaatttggggaagcatatagaaaatgtaagtagcatttacctctgagtgttaatcttggaaactgagtgttcactagtttggatgcactcactgcacttacttctcttagagccagggctcaagtaatagtgattaaacctcagggatctctttaacactcaagaaaaaattatttccttttccatattccaccgtgaaaattggctaactttattggtgatgagaaagaaacgatcctccagtggagctggaggccattattctaagtgaagtaattcaggaatggaaaaccaaatactgtatgttctcacttgtaagtgggagttaagctatgagtaggcaaaggcatgcagagtggaataatggactttggagactcagaagggagagagtgggaaggcggtgtgtgataaaaaaaaaaactatgtattgcgtacgatgcaaactactcagatgacaagtgcactaaaatctcagaattcaccactattgtccatgtaaccaaaaactgcatgtaccccaaaagggattgaaatttaaaaaaaagaaaaaaaaagattctccagaacaagggctttagtgacagcctaaggcaaatcatttgaggatttagtaatagattttctcagcatggaaaggctctgattccaaaaactgactcaaatatataaaataaaatgatattcaggaaccttatttatcttacttgaatctttcttgttccttcagcttgtcttttccatcctacaccttatcaacttttctttttcttttccttttttatttttattttttgaggcagaattttgctcttgttgcccaggctggagtgcaacagcacaatctcggctcactgcaacctccgcccccagggttcaagcgattctcctgcctcagcctcctgagtagctgggattacaggtgcccgccactatgcccagctaatattttatatttttagtagagatgggatttcaccatgttggccagccggtctcgaactcctgacctcaggtgattcgcccacctcagcctctcaaagtgctgggattacaggcgtgagccactgcaccaggcctcaacttttcttttgttctttgcttccactccaacaacttcctggactttgcatctgtaattgatttcaatccaccacaagtctttgctgaagatctctggtagatatcctgttaccagcatcatagtgaaccttctaagtatctcctggttttctcaagaaatcaaattcacttttaccctttttattctcagtgtatttcctggccttctttgaattgcttctcttctgttacaactttctttttctgacactcaggattcttctctgctttcctcgtttattcttcctactgtgcttgctttcaatctctacacttaccatcttctccagaacaccgccatatttttaatctctgccttttttgatttcgaatttgccaatatgctactctcccacatctttacacatgaaatggcattcttgcaaaagtaacaacagcaaacagcaacaatatgatatgatgtgatatgaactcgcatcgatatgcttggccctcaagtcaatgacacacagttttctttgtgatcaacagataaacttacggggagaataaccttgctggctccatgtattcacctccaggtactctttagccctttgcaaatcataactcttttctcacatctctattgaagctctttttccgaaggtcaccaatgacctccccaaaatgctgcttctatctcctgcaatatacagaacttctagccattgcttccctccttgctatttacttgcttgaaggctttgctgtcattaatcactctctcatcatcatttcctccacatctctttaggatcattttatatttacctctccattttattttgaccacatttatgatttttttcttctcacttctattataatacttcaggccatattgcctgtgtatacagctgatacggtttggctgtgtccccactcaaatctcattttgaattgtagctcccataattctcatgtgtccttggaggtaattgaatcatgggagagggtctttcccttgctgttcttgtgatagtgaatacgtctcacaaaatctgatggttttaaaatgggagttcccctgcacatgctctcttgcctgctgccatgtaagacatgcctttgcttctcctttgccttccaccatgagtgtgaggcctccccagccatgtggaactgtgagatcattaagcctctttcctttatcaattacccaatcttgggtatgcttttgtcggcagtgtgagaacagaccaatacaacagcttagttactttcacagtaacttctaaattcatacaactgtccctgcctcctccaccatcatcctagtccaagccaccagcatttctcatgggactcctgatttagcctcctgaccagtatccctggttacctctttttttttctcttataatccgttccccacaaagcgtccagagacatattttaaaagagataaaatcacataattcttttacttaaaacctgccaatgtctttttacagcacttaaaaataaaagcccttttcctaacttcaaagcccacccatctaaagtaaccaccatcacttggtatcacatctctgttttcaggagagcatttatcctaatttgattgattgttttctgatttatatttttcactattgcctttgtttatttgtagtctgtgtcttcttgctaggacatattgtctctgagatcagcccctcatccccttcttaaattgctgtgtcacaggacctggaaaagtgcctagcacatgatgacctcaatgtatattggctgaatgaatgtcttgtagacctttggagaatgcatctttaagtaaatgcccagcattctgtctggctcaaagttatatttatttaaaaattccaaaagatggtgtcgaattaccatccatgaaaactgctaaagatttactctcccaccaacagtgtaagaaagtgcctcttaatccatattcttggtcacagtaggtataatgaaactataaaacctttgtattgcctctcatggtcctgcgtgtctgctgggctctgcagaccagttctgctagtcctacttgggatttctcatgaggctgtaatcagttggagtttggcatcctctggaggacctccacctgcatgctgagacagctgggcatctctttttgggctccagttcatcctagcgcctttcctcttcatgtgatctctccagcagggtagctggactgctcacgtgactgctgaggagccgcaaaagctcatgcaagagggataaatcaccaggtgttcttaatatctgctcctagaattcctgaagtgctgctaggtttgttgtctcctggtcaaaggggacaggagctcagtccagaggccagagaggaggggtatgaatgtggagaaaagggtgggcttatctgaggccatctttggagcctggctgtcactataggtacaagtgagggagcagggctgtggcagtaagggcaagaattcccaattctgtggtagagcatcctcatgaattagaaggtcaggaaaggaactcatatgacaaaagataatgagacaaattagcataaaaacacatctcttgaaatttagctggtcctaaaatctagaagttctctttattatttaaagggaatgtaaatgaatatggcattatttttacatttattttaataatctaaattctatcacttttttagagttttattttacctatgcctattaaatttcatttttaaagtatcttttgcctcacacatgctactgcagaaacccacaagcatggatggaatcctccttgtggtctgtttctgacattggtttttctcaagtactccttttaaaacttgtggaataatactgaaacccccaacagacaatctgctctcctgtgtttattactgagtaccaaagccacagctttaaccaccgcagcactccattaattgtgggcatgggatgctcaggagaaccaccccttgtgattgtggcctgaaaccctccaggaggcctataattgactatctgacctccaaaacgggagtgactgtattaagggttccacataaagctgggtttggtttattttgtgattggtatgacacattatctgagcaggaagtccagatgttgtcaggcatgtaggcccataaatctggagaatgataaaaatgagattgtaggcatgcaaagagagatgactggaatggaaaaaaaaaaaaacccagtgaccctccctctgcaggagtcgctgcatgacctgaggtgggggctatagcttctttcctactaggtggaaagaaatgtagaagaagtggctttgctgatgtagaattgagtgtcagaggctactgacacattgcttttgccagagtgcatttttttccctacagtttctttagatgtgatacttatttctattacaaaaaaaaaacaataagcctacttttgatattttaattttttcaaattacacatgccaagaagaacaagcagattatatatgtacacacacacacacattttatactgtctgctcagggaagcaagcagatgttacaaagacttgtttgtttgccatgaatttagaaaatttgaaaacttaccaggagctggtactttaattttgtctttagttacagaagggaggaactagagcagttgttttgctgtgtcacatagttgtaagatatcatctgtgacttttgtcctcagctttctctgcttttctatccctactttctaaagataattttgttccacttccatctctaaatatcactctctttggggcatggtggtggaatgttgtgatgtgccactcagatccttcttcaggaacaaaggaattatcatgtccatggctggcagagctgtccccaaaatagccatgagttatcagccacctcttggaactgccccaccagaagagaggcacctcgccaaggtaagaacctttttgtggcaccactggcagttaatggcaaactcaagtgaggggctttggaggacatcctatccttgaactcagaagacttgcggaagctcatttcattttcagagcttctctgttggtcttgaattaaagttcaatctctcctcctgctcaatctttctttccctttcttgtcacagctcttgatctgagagcactctgggataaccttctcacaatgaatttcagaatgtgactcctgatgaacccaactagctacaatcttacatccatgtctccaactttatttccttgaacttgagtttcaaaattcaaacttttaaatcaacatttctgcttgcatttctaagtaatttcaactttaatatgctcagaaatgaatccttgatttttacgccaaaatctacttgtatcagaactacactgctcgatgaatatcactgccagtcatctagatacttagaccccaaacctaagcaaccttgactttgatctgttcctcaaaaatccacatcctattgatcaacattctgtcagccctgcctctttaatgcatcccaaacccaattgcctctcaccatttctactgctgtaatcctatccaagcttcaatccgttctcacctggcatatgcccataagtctcctaattgtatcgctgtctcctttctagtatgcttagatatgtcttccactggcagacagagagatcttatctaagacttaaatgagatcttgtcattttcctaactcttgctaatgattttcctttccaagaatcaaatccaaacttttcaccagaaccccatatgatgaacctctacttacgtatctcatgatccattgataggctcactacttctcaggcatgttgcctttctctctgtcttttgtacacaccagttctttttcatcccagggcatctgcaattcctgcttcttgggaggcttctctcccaagtatttgctgggtactttttctatcttctcctcccttggatctcaaatgtcatctcttcagagaggtcatcctgaccacctagttagagcaacttctaagcatcttctttacaccactcgttagtcttaaatttgttatttctggctaaattatgtccccacaaaattcatgttgaaactctgactccagtgtgtctatatctggagacagggcctttaggaggtaattaaggtcaaatgaggtcttaaatgtgaggatctaatctaataggactgtgaccttgtaagagagagagatgtctttctctaccacgtgagcacacagcaagaaggctgctgtctgcaagccagaaagagagccctcaccagacactgacactgttggcacctttatttcagacttccagtcttcaaaactgtgaaaaaataaattttggttatttaaaccacctagtctgtgctactttttatggaagattgggaagattggggtaccatctgtcttgctcactgctatatctccagtgcaaggaacagtgcacttaacaaaaatatattaactggcttggtgactgttgcctcaaaaattatttaagttagaggtaaaagacagagtatgaaaaatttaagtgctattctttccggtaatatggcaggctatatatctaaagaaactcccctgggctagattattcaagaatcaggttgaagtatgaaatatctctttaaatttataaaatagtgagagaaatacttgagacctaaaataacggaaggactataaacgatgaaagataatcaagcactaaattttggcagttgctccaagagatacgctaatcactagagttcaggagagagatgtatttgtgtatattctagtgaaaaagaaaagttagatacttaaacaaaacatggaaggacttctagtattcatataagctaaagaaaaatatttcaggaagttggtatatggttatcagacattgataaaacaagccaactgggagaaatgttgaaaaatttctaagtccagagtcaagattggaaaggtgaagaaaggagaaatcctttcgtggctttagtgcaagaggaaggggttttaatataatttttaaataaacgatttctttctctttttttttcttcttctcctttttcttgctccaactcctaacctcctcttctgtttctctctcatttttttctctcatttattttgtcactatttcattcatttactcaattaggagatatttcatggaccccagattttatgaatcactttctaggaaagataaatgtagacaagtgatctctaacctgtaaagagcttgtcgtcaagtcaggtgtgtgtaatagttacatcaatgagagtgtacgtgtgtgtgtgtgtgtgtgtgtgtaggtggtgggtaatgcagggaaaggaagtgggaaaaggaagaaaaaagaatatttgtaagtctggtattaactttaaattttatcatttccttttgccaacagctatcttaggatagctagaagaaactcctatgcattttgtgtattatgatttaggtagactgaatttttgctatcacttaaaggcatcctgtcatttttggttgaccagagctgattctgttatttgaggtatttttatacatattctaaggatagcttcgcttgttttttagttcttgcaagtctaattctggtcttaatagagaggtttctgtttaatgaaatggtagagttgagtttattaaaacaactacttaaggtacttttactctcattttaaaagctgaggatccaaaagtagattttatgttctttctcatctggagatataaaaatgttattaacattcaactagtctcaaaacccaaagttggaacccggggttgtttgaagaggaatttactggtaacaatgtgtggactgaaaatgagagagctattcaagtagtgtgctttgtggtggttgaggtttagttaatcatggtccttcaccatcaaagataacaaagctttggtactgctctgcacaatatcaaccctttgtattttcagatctgctcactaaggttgaattttatcattttcttgctcaaagattcaatctccattaacagaaacccactaagaggagtgcattttgtggcttcagcggcctaccaaaccaaacatttgcaggtcaactcaggagaagaaaaatgatctctttcaagatgactgttactgcacaagcagaaaaatatcacaaagcaggatacctttttatagataaattttaagtcatcagcattatcagtttttctctataatccctgctaattgtaaatatcaaattgcattggcagaatatggctacccagtaaagattagtgctttatccacatattattataaaacagttatcaaataatatattatacttctatttttcttatatttcttggccttctatgcatcacattttcacaaaatctcacagctgttacctaacttgagagtgtccatatctgggttttgcaggcctagcatccgttgaatctaaataatacacagcacattcacatttgattatatgaagcacaggaattcagtacattgctgtgtaggtagtttgttgccctggtgaatcatagcataatattaggatgaaagagatgggtaaaaggatatcatagtaatggtgatctgcaggaatcttgggctgttctggagatgaagggtaaatgtagtgaaatggactaccagtcatgatagttaaatttgtccaagggtcctttcctgtgaacagtttctgaggtctgtaactggcttgtagtcagggcaaatggatattcagtgtatgtccagtgaaggttcagggagaatgggaagaacactgacaggcagcaatgtatacctattatttaaatactgttcccaaatttgcaagttcataaaaatgtcactttcctatcacagaaggtccttttagacacaatgttttattactttaatatctgctgaattctgttgatattatttctgctgttttattattttaatatctgctgaattctgctgatattatctgctgaatatctgctgataagtatttcttcaaagtataattgtaggctaagtgcattaacaaaggatttccttttccagaactatttaaattgaatatttcagattgcagtggagtaagttccatgctctgttgacctgcttttttgagcaacatacttttggtcaactaccatcataaaggacagagatccatgtatgcagctgcaagatgaatgagaccttcaatctactggtgacactgcttaataataaagcagttagtaaagaaagaagaggcaaaaagaaaaaaaacatagcttttattgacaggaaggaattccagctgtttggacagttacgtattgtttaatagggtagattcttttaaaacctgaatgtgacagatatttacccaggctttccagctgaaactgaaaatagggtcacaataatcataaggaacagcagaatctatggaaccccagttctcttctatatccctccctgctagtttaatgagtccttagggagtctctcatgagcacctagagggccacaattgtccttttctttctacatttagtgcccatcttctcagctgattctgacacccatcagatagatcacgatttgctctactgatattctctcccactcccaatgttggctgccttggttggctatcaaaattgtcttactagcttgctggtcatttccacaacatcttattatgctacagggtagatgaactgaaatggaggtaaatatccttctttgcttgtgttacactttgtatctaggctaaaagcaggacaaattttatatatatgtggccaggaccacgtccatcaattcctggtcttgggctagaaaagaagttaagaagatatatattgtagttcattcatatttattctccctttacaactttcatctgtgttcttagaacaagtttgaaaaacttgattcactttagtctcagagtgtctagttctttatcttctacagtgtctgatagggaaaatggataaccattagcctaactttttgatgccaatttggagcttgaagttaactgtcacaatcaacacagtatttttttgtatatatatatatatatatatatacacacacaaaatatctatctatatatattactgctccttgcagagcagggctatcctctaagcactgtgcccagagaagcctttttttatgtttttttttaaacaagcaattagtctccatgcaaatataattaatatcagtataatatgttatcctaatagacattgctaacataatggaagttacaatgatacatggtgtagaccggttataccagaggtttttgtgtgtgtgtgtgtgtgtgtgtgtgtgtgtatcatttatctagacagagcaagtaggatttggtttctgtgcctggatcatcacattgagaaagattgctcagaatgaatgtgtgattgattaattacacctctcatggtgtcagtggtagaacaactatataattgccacccccaagctagagtgatggcttcttacactagtttacctctcactcctcacacagcccctccccaatcctgggatgtaatgaactagtttgatgattaactatttaaagagctagagcaccataattataatgcaaaaaaatagggagaggaattttacataaaattaaacataatattgaaagacgtacatttctactaacaagttggatcctaatcagatgacttcatttttcctaccaaaaaataaagaatcatgagagaatttggctaagtttgtctttactcttccctactttctgtggtcttctagttcatcagtggtataacttagatctctctcatattctgaatctctctccatctttttcaccttctcgttgctaaaacgtatcttagaccataactaagggttcattttagaacccattaatcatattgataaacaaatgattaacaggttcaataagaacctgttaattactatacattactatgatactatacgttactatactacttacatactatatgttatatatactatacgttactatactacttggaaacttggaaacttttctattacaattggaacctgttaatcatttgtttaccaataacaggcttttattgaacctgttaatcatattggtaaacaaatgattaacaggttctaattgcagtagaaaattttccacgtattatatctttcaagagtatacacatttaatatttttattcaataattgaacaaatttactgaaaacctcgtatgtaccagatacttatctaaattgtggggatgcagtggtgaataagaaaatcattgccctcaaaggacttatgttttagtttggaaagacagactgtaagcaaacagaagataatggatggtggtaagtattattggcccttcatacccatgttccacatcagcagattcaaccaatcaccaatcagaaatgtagttaggcttgtgatggttgcatctgtgctgaacatgtacatactttctgttccttgtcattatttcccaaacaaggcagttataaccattatttacatagcatttacattatattaggtattgtaagtaatctagagctaatttaaagtattccagaaggtatgaatgggttatatgccaatactctgccatcttatgtaagatatttgaggattttagtatctatagggagtggggggtcctggaaccaatccctgaagataccacaggcactgtgcagaggatgattacattaggatgatgtgaagttgaaaaatcagttaaactaggatgattgatcagtgtgtaattactccaagtggggtcattagaaaagacctttctgaagaatgacagttaaggtatctgaataaaaataaggatccaggcatataaaataccatagaaaacacaatttaaatctaagagtagaattttaggcacagtaaaatagataggaagacatttagagaggatgaaaacaatcttcatggccctgaaatcacactatctaatgctcctcctacatgcgcaatccgtccttattagtacatgcttcctaaatgttattagtatcggtccgataaatctcttaaatttacaatgtattaatttgttaattaaaagagatcatcatatccttgactaaagaagctatgtttaatagccagagagaggaaaaattcacctgcaaacacactattattctcaagagcaataataaagtcagaagactatggaataatgtcttcaatatgctaagagaaaaatcaattacaaattagaattgcaaacctggaaaaatgtgttccaacaatgttttttcaaaagaactaaagcagagggttaactgccaacagattttactaaaggaacatctaaagcaaacatttcagaatgaaggaaaattattttaaacatatgtagatgcataaataaatagcagataaattaataataaaatgttgtataatgtctgatgtctcagattgagaataaaaagaactgaaatactggacagaattagcctgtaggttgagagtagtttcattgcagttaaaatgatttatggttcttatcttgctcaggaggaaaattgcaatattaataaaacttctgtgcagtaatattgcaaagattacattaaaaaatagaagtagaggatataacttccaaacagtaaaagaaaaattaaatgaaatgagaaaacaaaactaaccaatccaaaaaatacaagagagaagaaaaagaagtatagaaaaaaaatgtggcaaggtgtacaaagtaagagggtgaaaaaattcagatatgtcagtagtcacaataaataaaaacagagtttattagataggtttaaaaataaaaaatatgagaataaagatgaataagtactagagatctaatatataccatggtgactaccgttaataataatgcattgtatgcttgaaatttgctaaaagagtagattccaagtgtacttacaacacacacatacgaaaggcaactatgagaggtgatgaataatatgttaattagctggattgtggtaatcatttcacaatgtacaggtatatcaaaatgtcatgttgtatagcctaaatctacataatttctatgtaccatgcctcaataaagctggaaaaatccaggaatagtctgataagagaaacacttaaaagataacttgagaaggtagaaaagaaagaaatgtaaaaagaacttgtgtaactattttaatatcaacacaaaatatgcttaaagttaaaagcatcagtagaaatagaaaagatgattaaataatgttgaagagctcagttcaccaggaagatattataattctaaacctacatgcactaataaaatcagttcaatatatatgcacaaaattatagaggaataagttcataaacacatcaccatcatgaagtgtgttaatacacctctttcctttcaaaggtcagacaaaagacagtaaattataaaaaacttgaacatcataattaatatgcttaaataaatagatatgcatgaaatcatccattattataaaacatatcttgttctcaaacacataaagaatatctaaaaaaattaattatgtatgtattattaatccataaagcaactctcaaacttccagaaactgatgtcatgcaaacaacatcacactggtatcacatagtctacctcagggaaattagattagaagtaaattgcaacaaaaattaacatatcaaaaactgaaattaaaaatcatatgtctaaataattcataggtcaaaaaccagaagtaataaatataaggtactatgaagaactggatgatgatgaagttaccatatatcaagacttatagtatagtatgcagtgaaagcagtattttaggagcaacatagtgtgaatttgccagtatttgaaaagaaggcaaaaatggaatgagtcagatatctaaattagcaaataaagaagaataatagaataaaccccaaaagaataatggctatagtaaaaaaaatttataaactagcaagggcaaaagtggtttctctaaaagacaatttgaacaaaactctgatgagactgattgaggaaaaaaggaaagaagttacaaatattattacagcttgaaaaagctcataactacaaagagcggaaattgaaaagatagatttttttccaggcaaatttatagaaaatgtttgagagtattaacaaaatagatgaattcctagaaaatatacaatatcaaaactgacagaagaggaaataaaaagttggctgaagagataataatttgaattgccctaaaatcagtaattaattgaatacctagtaaaaaatattttcacagagaaaacaactgcctcagatgactttacataccagttatactaagtattcaattaagatacaataattctcacaaacttttccagagaatagaaagaatgataacaggctggacgtggtggctcaggcctgtaattctagcactttgggaggccaaggccggcagatcgcctgaggtcaggagttcgagaccagcctagccaacatggtgaaaccccgtctctactaaaaataaatacaaaaattagccgggtgtagtggcaggcgcctgtaatcccagctacttgggaggcggagacaggagaatcgcttgaacttgggaggtggaggttgcggtgagctgagattgtgccattgcactccagcctgggcgataagatctagagtttgtctcaaaaaaaaaaaaaaaaaaaaaaaaaggaaagaatgataacaattcccaagtcatttaataaggtctatataaccttgattctaaaggtaaagaaaaggagagcatgagaaagggaaaaaagtggttatagaatggttatagaagacagaaatataacacaaggacaataatataacaaacattaatataatagaaatgacagtaatataataaaaaagaactgtatgggaatgaagaatacattccaatctcatagttgaaagtctgatcatttatgtattaaaaacatataattcatagtgaacaagttaggtttatcccaggaaaaacatgtgctttaaaacaataataattatataaatttcattcaccatgaaagagaaaaaatatgattacctcaatcaatgcatgaagatatttcataaagttcaacattccatccatgataaaaatttttatcagaattggaatagaagagaatatctttatcaaaacctaccaatgatggatgtcaaatacaaatctttttcaaaattgtattttatttcaatagtttttggggaacaggtggttttttgttcatggataagttatttagtgatggtttccgagatttttgtgcacctgtcccctgagcagtgtatactgtacccagtgagtagtcttttatctctcacctctatcctacctttccccttgagtccctgaagtccattatatcactcttatgcctttgagtcctcatagcttagctcccacttataagtgacaacacatgatatttggttttccattcctgagttatttcttttacagtaatggtctccaactccatccaggtggctacgagtgccattatttcattcctttttatggctaagtagtagtccatggtgtatatgtaccacattttctttatccactcactcattggttgataggcatttggcttgtttactattattattattattattattattattattattattattattgcccaggcttgagtgcagtgtcacgatctcggcttactgcaacctctacctcctgggttcaagcaattctacctcagcctcccaagtagctgggattacactcatctgccaccacacccggctaaattttttgttttgttttgttttgttttgttttagtagagatggggtttcaccatgttcgccaggctggttttgaactcctgacctcaagtgatccacccatcttggcctcccaaagtgctaggattacaggcatgagccaccgtgcccagctgcctggttacaattcttaacagctaaatagtagaagtgttccctgtggaattaggaacaagacaaaagtattcaccatcacctcttctatttagtgttttaatgtaggttctactagcaagacaagaggtaaacgtaaaatatatggatactggaagaaagaaggataattcattattcacggatcatattattgtcaacttggaaaacccaaatgaatctgcagacaacctataagaattagtaacggagttaaaaatgctgtttagatatggtaaaatctatatagaaaagtaaattacattttaccagagtctatttataaaaacatgttatttatcataaagctcataaaactaacaaatgcatctaggaataaacctaaaaatgaatgcctaaggcttttgtggagacagttataaacttttaagacagatattaaagacatctaaaccaaagaagaaataaaatcatgttcattgatagaaagacacaatgtcacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcaattcctcagggatctagaactagaaataccatttgatccagccatcccattactgggtatatactcaaaggactataaatcatgctgttatacagacacatgcacacgtatgtttattgcggcattattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggactgttgtggggtggggggaggggggagggatagcattgggagatatacctaatactagatgacgagttagtgggcgcagcgcaccagcatggcacatgtatacatatgtaactaacctgcacattgtgcacatgtaccctaaaacttaaagtataataataataaaaaaaagacacaatgtcaccaaggcataaattttctgcaaattgatctttaaatacaatgcaattccagcaaaaaattaagatttttaagaaacttgatgtatttattggaaaatatatatatagatgaagagggtctacaggtgagccaaaacctttctaataaagtataacaaaaggtagatttactctgtcagaaagtaaggtatttttaaagcaataaataatcaagagagcctggtattaaagcagggatagtaataccaagaaatgcaactaccatggtttcaatttctcctgcaaaactcgtgttgaaatttaattgccaatgtaatggtattgggaggtggggtttttgagaggtgattaaggctctgccctaattcatgaattcatgctattacctcttgggaatgggttagttatcctgggattgggctcctgataaaaggacaagtttggcccccgtttgctctctgtcttatgttctcacataatattctgccatgggataactcatcatgttcttggatttcctaggctccagaaccatgagtcaaataaacttctgttctatttataagttacttagcttgtggtattctgttatagcagaagaaaacaggctaatataggaacagtatagagagaccagaaacagacccataagtacatgataatttgatatatgatagagatgtaattacagatcactggggaaatgtatgactattcaataaatggtgctgagatatttggttacctatgtagggggattgactatactatacacatagcatcatttccaaagatattaaaatgagcaggtgggtgtttgtgaaatgatggatatgttaatttgcttgactgtggtgatcatttattgtacatatcaaaacatcatgttgtacacctgaaatacatacaatatataaaaaatgcagttgaaaaatttaaatgggaaaggcaaattttaaagtatttagaggatagtataagggtgactaccttaatgagttcaggatatagaaaagtttttaatgaggcataaaatcactaaatacaagaagaaagattgatttactgctttgaaattattaactctttttatcagatgacatcacaaagactaaaacgttaaaacctgaaaagtatatttctgagatatataactgaaaaagaatttgtatcaataacatataaagaaatattacagattactaaaaattaacaaaatactaataataaaatggtcaaaagatatgaacagacatttcaacaaagggaaaacataaacagaaaaacatatacaacagaaaaacttacctgtgaaaagatgctggatcttattataaatcaggaaaatgcaaataaaagctgcatgagatacagcttaacacacacaagttgccaaaaacgaagaaactggagaatgccaagtgttttgagtgctccaatgttgctgtgggaaactatatggtgcaaccactaggaacatgcttttctgcatgagctacaaccctgcaaatccacttcttgatatatacacccgagaaactcttgttcatgttcaccaagagatgtatacaagattttttagtagaaggattgttacagaaaaaaactggaaacaaaccaattatttatacacagaagaatacattttgaaattatggttcattcacacagtaaaataacaatgaaaatgaatgaaccacaaacacagaatatgattgaatctgagaaataaaagggagttttagaagtctgtatacagtatgatatcacttttataaagttcaaagccatgcaatattgtgttcagatatacatatgcacatgcaataaaagtgtaaataataaggcatgataaataacaaaaccagaacagtggttacatagaaggcttgagagtgagttgccaggtgttttgctattatgcatcacaatatgtatgtatgttatatacatattttatgtagatatctaatgttgcaaaataaaactgaaaaattgtatttgtttttcaggataatagttctttaagaaagaattgggaatgaagaatttagcaaaataatgattttgaggatgactgatattttcattaagtcactctgtatccctgaatttcagaaatattagttggaaatggaagtcactaacataacctgaacacaagctgtaaactatataatacagatgtgaggttcttgaaataaaacaccatctgcttacttgtaagtagcaacaggagaattacactgcatattcagatgactaggttcttaatctacctttgctgttggcatcctgggcatatttggacaacttgcctactttccttgattcattttaaccatccatggaagtagaatatgaatctgtaatgttccttttgatttaaagataatactggtgccattctttgtatcttaacgtttatttttatgttctgtttttattccttctctccccagagaaaacacctaagggctgtgttacaatcacagtgataatcaattttatctttacctagataattataggactccgattgtggctggtataagctatttctagcataacttgtggctggttctagctctcctcttagagagatcttaggtggcccttgttttattttgatgaccctgctatgaccacggaacttcagtatgtgacaattcactcctacctcaagatgtcctggtggtaccttctaaactagcacctcccattcctttatggaaatgtgcaggccttcatttctcttgctttgtctggcaccagaaaatcagttattcccaaatcccttaaaatttttattccacaagtccttatggaaatgggactactggtagcttgttcagaggtcccggtgtccttgagctatgtaagcagttagaccacaccatgaatacattagttaagcactgcctcaataatgctgtgtaaaagcattcaaactcagtggcttacaatggcaagcatttggttttgtcactgatttgtgtgtagatctgctggtctgggctctacaagcctccatattcttctgggatcagaggctaccttgggcatatcgtttttttggaatatcataggcatgcaaaaagccaaaccaaactacgcaaacatatgtatggcctttactttagtcatatctactaacgttccgttcgctaaatcaagtcatatagcaaatgtcaacatttagagggggaggagaagaggagagggaaggggaagaaaacaatatatatgtgtaaagtatattcttttcccattctaacacattgcaagatcacatgagtaagtgaataaatgagaacaataatcgaatccaccaaaaagtccccctgaatattatatgttataaagtcaaaatagaaagtcaaaaagaagcacttagagtaaatagaaaagactttcattgttttttgttgacttgcaaccttcaacctggtttcacattattagtttgggttaagaaccatcactaaggtggtagaaatcaatagatttccttgatttacatatactttagagtaaaggtgtgttcaagtgagattaagtcagcagataatctagacagtgacaaataaaacaaaacattttctccagctatgctgacaatggattggagggaataatctaaaatgtgcatgatgaatttgtggtctaatgaatgacaatggaggtgtggtgggaagagctcagactttacagcgagacaaatctgattctgaactctagccccaatgattgtcagctttcagcaacttgcttagattatctgagactcataatctttgcctgtaaaatgaggattatgtcatctctgagatactgttgtgatgatctttaaacagttatgtgaaagttttaatataatatctgatatttgacatgcaagaagttgcaactatcattctggaagcatttataagatacactaaagagcagtttagacatttctggatgtcttttaaaataatttctttcttctaatatggctaagatataatttcacttgaaaaaagatgatatcctcctagaaactcttcaaaatcttgattcaatgattccaaaaagaatattatttattcatttgagaaaaccatttgccacactgctacatactttcagatgtgaaaataaagggatcgcagctggttgctttattttcaaacaactacaaaggaaacagtagaattttggcttcttgtaattttcctttgaaaatgttcacaaccatgtgtggttggaatctggcatttatcttttgcttccattctggaaatttatacacttctgtagcgtttggtttgggtcacataacttttcaattctttgtcatagtcttccacttgtataatttccgtccagtgtgaaaaacatataccataaggtgtttacacagaaagactttaggcataataattgcctatggatcagaagagctagcacagaaaaattagtcatgcataataaggaaacaaaaaatgtatcacattattttatgtgaatgaccaagactgagtgtacaggatgtaatcaaagtcaaacaaactttgtaaccattgactttagaagaataataaaaatacattatccagctcccatacataaaatatactagtttccaagtggacagatgagtcctgccaaattttaaatcgtttaaaaatttattttttagagactttcaaaagcagctttttaagatcatctaggtgatgagagttgatgtcagacacctatttccttgctctctcagttctttattatatccatgataactgctctgcttatactttgaggagaaaaatgattctcgacagaagtttataaggaaattaaatctctggagattttttttttttcttcaaaaaaaattcaacttctactgtccttactggaactttttcctggttctgttgcccatattttgactacagctttctcaaagctgaattttatatttccatctccttgtagatccctttaactttttatttcatggtctccctagtctaattctgatcctcactaccttattcttgacatcgactctttctctgcctagggaaacaggacctgcctctgactgacttacaatttttttgagtcaaaataatattattatgagtcaaaagtcttattttgttcaacttgattgatagagagcttgatttgtagaaccttctagcatcagtattggtcatccatctattctgcatttactgagtgccagctatatgccagacattctaccatgccccaaaatacagaaaaagagattagaaaaccagcaattgcagcctgtcagcacttgaatgagatctgctgcttactagttgtgtcaccttgggtaagtttcttgaatctattcttcagtttgttatctgtaaaatgatattagtgccctatgtcatcaagccgttttgaaggttaagtaaggcatatatgtatattgcttcgagagtccatagattattctgtaaacaaggcaagtcctgtggcctcagacctgtctaatcaccactcctgtcctggtcttttgccttcactggacttaccatttatgtcaattaaacaggagaggcagttgatattgaaaagtaggtgcaaacattgcaaaacccattaaaagataggtttttgataatctgtttgttctcatttgcagaatcccttttaaaagactttgaagttcagagacagatactatagttctgacttgtaaggggccatacatatcctgtatcacagctaaaaatggtataggctcatctggcttttaaaaagaagaacttgagcagatattaatccaaagaagacatacaaatggccagcaagtgtatgaaaagatgttcaacatcattaattgtcagggcaatgcaatcaaaactatgagaatttatcacctcacacctgttagaatggctaatatcaaaaatccaaaatataagtgttggtggggacttcgaagaattagaacacttgtacaccattggtgggaatgtaaaatggtctagcagttatggaaaacagtatggaggttactcaaaaaaatttaaaaggaactaccatatgatccagcaattccaaatctgggcatatatccaaaataattaaaatgaggatctcagagagacatttgcacactgatgctcattgcagcattattcacagtagccaagatatgtaaacaacccaagtgtccagtgacagatgaatagataaagaaaatgtggtatatacatacaatggaattatttagccataaaagaagggaatcctgccatctgtgacaactggagaacattatactaagtagaataagccaggcgcagaggggtgaatatactgcctgattctgcttacatgagatatctataatagtaaaacttacagaggcagagaatacaatgcagttgccaggggttgggggtgagggaaatagggacttgttcaatggatgtaaagctttacttgcgctagataaagaagttatagagatctgctgtataacataatacttatagttaataataatgcattgtacagttcaaaatttattaactgggtagattttatgttaagtattcttatcacaaaaatgggacacaaagaaactttgggagtgttgggtatgtttattaccttgattgtggtggtgttatcactggtgtttgcatatgtctaaactcatcaaattatacacatcaaatgtgtgcaggtctttgtatatcaattgtgcctcattaaagctgttaaaaattttggcttcatttgataatgagggctcttcaaaaaggctgatcactgcttacaagagagaacatactttgggctgcgtactgtctttatgtgagtagtcctcatatgtttacacttctttgccttatgtttatgcaatcttataacagaatgagatagcattttaacactggtaaattaatatgtggcctgggagtgtttagatttagtagaattaaaatggtttaaattgctaaacaagaacagtattcatgatccaaatatattacttttgtatatattgtacaacaaaccattatttcattacttaacttattaagctgacagttattaccacagactaggcacttaggatacagatatagaagacagtttctgtcttaaagaactaatcatttaatgtaaaagatatatctgaaaataaatgtttataagcacaatgataacactagtatacacgagctatacatggatattaaagaactgaagagggaccaagagaatgtgtacttattgcagtgatttatggtcattggtttttcttctttaacttattagatgctgcacaaatatggacaacattctgtagcaaagctaagtacacgtttggaacttgcttttttctaacatgaaattttatttttatttgtttttaattttttgttaccataggtttttggggaacaggtggtatttggttacatgataagttctttagtggtgactggtgagattttggtgcacccattacctgggcagtatacactgaacccaatttgtcgccttttatccctcgcccccatcccaccctttccccacaagtccccaaagttcattatatcatttttatgcctttgcattttcatagcttatctcccacttatgagtgagaacataagatgtttggtcttccactctgaggaacttcctttttaaaatgaaggagctaataaaattggcttctcacattgtaaaaaaaagtcatgagaaaaacaatacattatgaattgattgttatctctattttgtagtaagtgagagttttgcttttccttgaattactgattttttggctggttgttttgttctttctgtgctgtgcagatacaaccatacgtggttgtattttgtagtctgaagaagtttgaggtgatatgtgcttgggatgtctcattagaaaaacgtttgggacaatagagagaaaaagaccactaaaatgggaagactcatctcttctttgcagttttaccagaaattggagctcttaagtaataaacaaccatcaagtaattaaagaatgaaaaatgtgattttcattatagcatgaattgtgtgattcttctctatttttcttttcttgccaattccatttggtatgattgtgaaacgccattaataagcattgtaagtcctttcatttcagaagttcattttggttaccaataaatgttttgtgtaggactaagtggtatagtttaaaattttttttctcttctcaaaacaattagtttgctgaagtcagaaaatatgttacctgagtttaattctttctgttgaagactattctgtaaccatttggacatttatttacttcatatggtcaaccacctctcttcatttgatcacttctacattaaaagtctataacatggtatttggggcagaaaatgtaaagaaggataagtcacaatccctgaatatcagtagctttccacctagtagaagaaactgaatgcaatgatatctataatacagataatatttgacaaacgctatgatttattcattcattgaacaaaaatgttttatgcatctctcatattctgaacactatgggagattctggggatagagacatgaagaaggcagagacattttgtgacctcacagcttggtgggaatgacagacatttaccaagaattaaagagccttcactatgggccagacatgtaagaaccagagatagaaaaccctgagtaaaggtgctgataacttaatgaagaagagcaccagaaaataagcaatgactaagtattatgataaactcacaaaaaaggtgtaggtaggacattacaaaaggacataaaaaatgaagccatcatcctattttctaatcatgtatttccatacgttgttttattacatgctatataaatatgggcaacattttacaaatgcttggtgagtgacttattatatgttatgttgaatgtcacagagtgatatgagaatgtagaggaaaaattactctctttggtattttcagagatagttttctgaaagacctgtcatctgaggtcagttcttcatgaaggactggtagtattcaggagaggaggattccagattgaggaaacagtgtgagctaatgtacagaggcaggaatttagcacatatagaatcgtcctacgtggatagattgattgtaggattaaagagtgttaagccagaggtgaaaccccgtctctactaaaaatacaaaaaattagtcgtgcgtggtggtggcgggcgcctgtagtcccagctattctggaggctgaggcaggagaatggcatgaacccaggaggcggagtttgcagatccgagccgagatcgcaccactgcactccagcctgggcgacagagggagactccatctcaaaaaataaaataaaaataaaaataaaaattaaaaaattaaaaagtgttaagccaggaaaagcattttctaaggcttttccaggtcttgaggagccttctataccttgtaagaagtttaggcggtatcttgagagtaaacttcaacatcgaaggcaataaatggaaccaggaagacatccggtacccacaaggaggtgtaagagacaaccagaaagaggcaaaaaggacaaagcacggggaatctggggtaacatttacttctagcagttttaaaaattttcttaaagttatgtatgacgtttattcactgagtcccataatttttgttgagagatgaagtatcatatactttactaagtattattgggtcgagaacgtaaaaaattcaaaatagggtataaccacaaggcaggaagatacattaccaactcacagtaatgtaagtgagataaatacatgctaaaacaaaaggagcacaatgtgtacaaaagaagcagttaattctgaacaaagtgattgagaaaggatttgtggacaggcagtctgactctagagcctgatggccatgatgtgtgttgggtgtaatcactggctctttgcatcttggatggagttccttgggaccagattctgataagaaaagttgatgcagaagatttataggataagacttttgaaagaaagagaaattgacctgtggcacaggtgctctgaggagttggtcaatcctcagaagctcttgagctaggaagacctttcagaggtgcactgaattgaggtaatttggccgtgtctttatatctgtgcatctgttagtcattggcaatgggaaattccttggaaaggttataaccttggggaagacagttttctgcaactaggggcaattcccagtgataaatagagctgggagctgcgaacaatgtttaaacttagatgagcccaatatggtaggtggaaacccaattccatgctgtgcactttccttttaatttttgcattgaaggctatagaaagatgtaaaaagatttgagaatatgaggtggcatatatggattttagttttagaaagttatttctggtagtactataatgtataatttggtgaggtgatatatgctgacaagtgaaacccatttgtagactattgtaataggtaagttccaattcaaacctgtgtgaagttttcccatatctcagccagaatagtcttctctctaccattctcccattagttatatttttattttagccccaaccaaacccaatttatgccatcagtagttgtatctgtgtatgtcttgttgtagtctgtgaatttctttaaagcaatagccatacagacatattcttgtctgtatctctcaaaggaccaccattgagccatgaataaaatgggcattggtaaaaatattttgaattaaatgtttctttcttttcttttcttttgatacagagtctcactctgtcataaaggctcccaggctggagtacactggtgcaatctcagctcaatgcaacctctgctttctgggttcaaatgattctcatgcctcagctccccaagtagctggaattacaggagtgcatcactgcacctgactaatttttatatttttagtagagatgagggtttcactatgttgcctaggctggtctcaaattcttggcttcaagtgatctgcctacctcggcctcccaaagtgcccagcctgaattgaacatttcaattgcattcagggaagaaataataagcttctaaaactgggttaatagtagtaagaacaaagagaatgtcactggtgaggaacactaaggaggtagaaagtgaaaaaggacttttgggcgtgatgacgtaacttctgtaatatataaattatttgtatatcaaatacactgaaacacactactagaattcatttatgtttatatatttatttggtacattttcccaggccatttcttaaaacacttcccctctttacataagtttctcaaagtttgtttttccaatttatacttcaaagagaaaacataatttgaaagttgtttctaccctttgatgttgttttataacgcttgcctaaggcattaaagttcaggttaacagttctgtcttagtaaaactgattttgtaagatgcttttctgcccatatttcaaatgaatgctttgaattcctttgccaactctgtcaaggttatatgactccagaaggccatcaaaacttccagaaagtcaagaataaaagtatttttctttctcggggtatgatttggtcaagaaaagacatgacctatgaaaattaaaatatatcttggaagcatgaaaatggctttgattcaagtgtgtaaagttttccaaagctgagagggagcacatttaatctgtgaacaaagacattataatctggtggcagacacatggtatgtggcgtcagaaaacacagactgacaagttatatgatcatgggcaactcaatgtttctatgttttattcttctcttcttaagaatgagataacattatttcttgttgtaaccaacttgtcagaatgatgtgaggatacaattagccaagtgaaatacatggctagaagaagcagtgggaagagccctgtgggcactctgggtccaaagggaagccatttttgactttgtctcacaggggtccttggagagagctgccagtggtttggggaaagaccacagggagaaggaaacttccatctgaactttgtaataatttcgatctaatgtgaagtttcctggatagaatctaggggagggggtgaaaggggagtgcagatatgagcacagaagccacagcaggtggtgggcaggattcctgaaagccctgcttgctttctcagtggggaggcttagagcctagggcaagttctcagcttctcagccctgctcatctgctgcctggaaataaaatcagtgctattgcgggggcggggggggaggggtgggaatggtgggaatgagaccagccttttggctgtgtgggagctgggtgaggcctatcactgccagcttttccccacttccctggcaacctgtatgacacagcgagggtgtcataatccccctgaaaacataactccataggtctgagagccatacctccatcccctacagcagccacagcaagccccacccaaggaaagtctgagctcagacacctctaaacctgcccccaccttagggtctttccctatctaccttggtagccaaagacaaaggacgtaatctcttgggggctctatggccctgcccaccaactgagaaacccaaatatttatccaggcaaccctagggcaatcttgtgtcctccctatactattgcagctgatgctctcctgaaagtgccacctcctagctggaggccaaacaacacaaaaccaacacactaaacaaaactataaccaaggaccctcacaaagtccaattcactcctctgctacctctactggagcaggtgctagtatccatggctgagagacatgaagacagatcacatcacaggactctttgcagacactccccagtaccagccgagagcctggtagctctactggctggtgaaactcagcagagaaataacaatcactgcagtttggctctcaggaagccccattcctaggggaaggggagagcaccacatgaagggagcaacccatggaacaaaataatctgaacagtagcctttaagccccaaatcttccctctcacataggtctacccaagtgagaaggaaccagaaaaacaattctggtaatacgacgaaactaggttctttaacatccctgaaagaccacatagctcaccagcaatggatccaaaccaagaagtaatctctgaattgccagaaaaagaattcagaaggttgattattaaactgctgaaaggtgaatatcaacttaaattaaaaaatgttacaggatatggatggaaaaatctccagagaaatagatagcataaataaaaatcaaacacaacttctggaaatgaaggacacacttagagaaatgcaatatacactggaaagtctcaacaatagaatcaaagaagtagaagaaagaatttcagagcttgaagacaagtcttttgaattaacccaatctgacaaaggcaaagaaaaaaatgaacaaagcctccaggaagtttgggattatgttaaatgaccaaacctaagaatgattggtgttcctgaggaagaagagaaatgtaaatgtttggaaaacatatttgagggaataataaaagttctccagccttgctagagacctggacatccaaatagaagaagctcaaagaacacctgggaagttcattgcaaaaagttaataacctatgcacgtagtcatcaggttatctaaagtcaagatgaaggaaaaaatctgcatcaggtaacatataaaggaaaacctatcagattaacagcagacttctcagcagaaaccttacaagctggaaaggatttgtgccctatctttagcttccttaaacaacaaaacgataaacagccatgaattttgtatccagtgaaactaagcttcataaatgaaggaaagatacaatgtttttcagacaagcaaatgctgagagaatttgacactaccaccccagcactataagaactgttaaaaggagctctaaatcttgaaataaatccttgaaatacaccaaaatagaatctccttaaagcataaatctcacaggacctataaaacaaaaacacaatgaaaaccaaggtatttgggcaaaaaatagcacaatgaatagaatagtacgtcacatctcaatactaatgttgaatataaatggcctaaatgctccacttaaaggatgcagaatggcagaatagatacaaattcactaaccaagtatcttctttcttcaagagactcacctaacacataaggacttacataaatttaaggtaaaggggcggaaaatgttattccatgcaaatggacaccaaaagtgagcaggagtagctattcttacatcagaaaaaaaaaactttaaagcaataacagttaaaaaagacaaagaaagatattatgtactgataaaagtcattatataatcactagtctaacaggaaaatatcacaatcctaaatatgtatgcacttaacactggagctcccaaatttatgaaacaattactactatacctaacaaatgagatagacagcaacacaataatagtgggggacttcagtactccactgacagcactagagaggtcatcaagacagaaagtcaacaaaaaacaatggacttaaactataccctagaacaaattaacttaacagatatttacagaatgttctacttaacaactgcagaacatacagtcttttcatcagcatatggaacattctccaagataaaccatataataggccacaaaacaggtctcaacaaattaaagaaaatcaaaattatatcaaatactttctcagaccacagtggaaaaaatttgaaatcaactccaaaaggaaccctcaaaaccatgcaaatacatgaaaattaaataacctgctcctgaataatcgttggatcaataataaattcaagatcaaaattaaaaaattatttgaactgaacgataatagtgacacaacctctcaaaacctctgggatacagcaaaggcagtactaagagaaaagttcatggcattaaatggctacatgaaaatgtctgaaacagcacaaataaacaatctaaggtcacacctcgaggagctagaggaacaagaacaaactaaaacccaaacccagcagaagaaaagaaataaccaagatcaaagcagaagtaaatgaaattgaaacaaaaaaacacaaaaattaaattaaacaaaagatgttttttgaaaagataaataaaatgggtagaacattagtgaaattaatcaagaatagaagagacaagatccaaataagctgcattagaaaagaaatggaagatattacaaacaataccacaaaaatacaaaacatcattcaagcctactatggacacctctaattgcacaaactaggaaacctaggggagatacataaattcctggaaatatacagccctcctagattaaaccaggaagaaataaaaactctgaacagaccagtagcaagcagcaagattaaaatggtaatttaaaaaatgccacaaaaaaaaaagtccaggaccagatggtttcacagctgaattctatcagacattcaaagaagaatttgcaccagtccttttgacactattccacgagatagagaaagagggaatcctccctaaatcattctataataatgataaatcattatcaccgtaacaccaaaaccaggaaaggacataacagaaaagaaaactacagactaatatccctgatgaacatacatacaagaatcctcaacaaaatactagttaactgaatccaataacatacaaaaaagataatccaccatgatcaagtgggtttcataccagagatggacagatggtttaacatatgcaagtcaataaatatgatacaccacataaacagaattaaaaacaaaaatcacatgaacatcttaatagactcagaaaaagcatttgacaaaatccaacatccctttatgattaaaaccctcagtaaaactggcctagaagggacatatcttaaggtaataaaagccatctatgacaaatccaccgccaacattatattgaacggggaaagttgaaagcattcccctgagaactggaacaagacaaggatgcccacttttaccacttacattcaacatagtactggaagtcctacgcaaagcaatcagacaagagaaagaaagaaagagcatccaaatcagcaaagagggagtcaaactgttgctgttcactgatgatatcatcctattcttataaaaccctaaagacgcatctaaaaagctcctggaactgataaatgaattcagtaaagtttcaaaatacaaaattaatgtacacaaatcagtagtcctgctatacaccaacagcgaccaagctgagaatcaaatcaagaacacaacctctttaacaacagctgcagaaaataaaaacaaaaacagaaaacaaaacaaaacaaaaaaccttaagactatacctaatcaaggaggtgaaagacctctacaaggaaagctacaaaacacattgatgaaagaaatcatagacaacacaaacaaattaaaatgcatcccatgctcatggatgggtagaatcaatattgtgaaaatgatcatgctgccaaaagcaatctacaaattcaatgcaattccaatcaaaataccacgatcattcttcacagaactagaaaaaataatcctaaaatttatatggaaccaaaaaagagctcatgtagccaatgcaaaactaagcaaaaagaacaaatctggaggcatcacattacctgacttcaaaccatactgtaaggccatagtcaccaaagcagcattgtactggtactaaaaataggcacacaaaccaatggaacagaatagagaaccagaaataaagccagatacttaacagccaacttatctttaacaatacaaacaaaaacaaagtcggggaaaggacagcttatttaacaaatggtgctgggataattggctagccgcatgtaggagaatgaaactggatcctcatctttcaccttatacaacaatcaactcaacatggatcaaaggctgaaatctgaaacctaaaaccataaaaattctagaagataacattggaaaaacccttctagacattggcttaggcaaagacttcatgaacaagaacccaaaggcaaatgcaacaaaaacaaagataaatagatgggacttaattaaactaaaaagcttctgcacaagaaaagaaataatcagcaaagtaaacagataacccacagactgggagataatcttcacaaactatggatctgagaaaggactaatatacagaatatacaaggaactcaaacaaatcagcaagaacaaaccaaacaatcccatgaaaaggtggtttaacatatgttttcactcataagtgagagctgaacaatgagaacacatggacacagggaggggaacaacacacaccagtgcctcttagggggtgggaggcaaggggaggaaacttagaggatgggtcaataggtgcggcaaagcaccacggcacatgtacacctgtgtaacaaacctgcatgttctgcacaagtatcctggaacttaaagtaaaataaaatgaaacataaaacaagaaaagaaagaaaagggttaagaacatgaatagacaattataagaagatacacaaatggccaacaaacatatgaaagaatggtcaacttcactaatgagcagggaaatgcaaatcaaaaccacaatgtgataccaccttactcctgcaagaatggccataatcaaaaaagcaaaaaataatagatgttggcatggatgtagtgaaaagggaatacttttacactgttggtgggaatgtaaactagtatagccgctatggaaaacagcatggagattccctgaagaactaaaagtagatctaccatttgatccagcaatctcaatactgggtatctactcagagaaaaagaagtcatcatacgaaaaagatacttgcacacgcatgtttatagcagcacaatttgcaactgcaaaaacatggaaccatcccaaatgcgatcaatgagtggataaagaaaatgtagtatgtgtatgtgtgtgtgtgtgtgtatatatatatatatatatacaccatggaatcatactcagtcataaaaaggaacaaaataatggcattcgcagcaacctggatggaattggagatcaatattctaagtgaagtaactcaggaataaaaacaacatcgtatgtcctcactcacaagtgggagctaagctatgaggatgcaaaggtgtaagaatgatacaaaggactttggggacttggggaaaggctgggaggtggggcgagggataaaagacgacatattgggtacagtgcacactgttcgggtcacgggtgcatgataatctcacgataatctcagaaatcaccatcgctgtaacctaacatcaacttttccccaaaaacctgttgaaatttaaaaaatacaattaagtggaaatggtttctatatggtaaaatgccgtgtaagtctttgtttgtataacatttcttttccaagtgttttcgattttaaacaacccatacttagaataatacttgatttaactaactatagttgtggaatatattgtgtttggtctttggttagctatggtaactaaaattcattaagtgctaacccgtttatcaaccattttgctaagaataatctcatttaattcttctaacaatgctatgatgaaggtaaaatcattttaccaatgagagaaccgaagtatacatagggatatgagatggtttttaaactgccagtatactacattattacatgtatatagatagacaatggtggagcttaatgtatgagcacatgctgtgctgtgtatatgtatgtgtgtgcatacgtattatacatacagaaatacataaatatctacaacagggaaacctgcttatcagcaaagtatgctgctacagacatataaggtatacataactaaatataaatttggagtagttaattttggaaatcatctacgatgtgtgaaacgccatgttcaatgctctaaaccagtgttgccttgtagaagtttaacatgagccgtatatgtcatgtaaacttttctgatagccacattaaaagagtaataaaacaggtgaagttaatttaataacaatactagctatatcaaatgatttcaatccctatttcccttacaaacacaagaaaaaataattgatagaaaaattaaatcactattttatattacaaaatcaaggctaacttttcagttttaaaagtttctgcttttgatattgatgggctgctgtgggcagtctacacttatagatcactagccttgtgatggagggctctcatttctgagacagctgattgtattttttgtgcaatccttgatgaaaaaataatggatgttttttcagtttttttctgaactatatttgtaaccaacccatgactgtatcctctctaggtatatgttctatcccactaaattccaaagcaaagtgattattaattatttaaattccacaaatatgtattgatgttttcttctatgctaagtacagatataattctgaaatagctttttcactggtggagctaatagtctatactaaaggaaagataaataaatatataataaaatgcagtaagtgatttgtttctaagatatcacacagaaatacagtataagagcacttttctcctgtacctttacttctttcaaacctactacatgagatagtaagacacagttgcttagagaataaagaaaactgtggccattgcctgaaaggagtgaagtttgatgctttggtgaatgagaatttgataaatatttagaatcttctgtacacttcttatctgaggatgttcttagtttaaaaaacatttaaaactcaaggtaatgcatgcagtgtgaaattatcaaattttgttttattatcaacttttaaacttattattgaatagatggatattagaacattttttaaaatgtagtaagcatttggttagttttgctagccaccgttcaagcactgtttctacttggagagaatgcttcattgtgcgggggttggaagtcaattgtatattccttctccatactccggggcagtcagggcttggacatatgacctatgctcagccaaggtagagtccagtggctccatagagggtgtttagttggggtggcaccaatggtggcatcctaactagactgttcctaggttatgacattggctcttttcttgactgccatgtctcttttgcttcttgtcattttctgagccattcttttcattttctgagctattttccagcattcctgttgattctgtgaactactaatagtctactaaataatttgattttgaaatcaattagccaaagtcagttttatgcatttacaatcaaggatttaacttctatggtgcttggcaccagaaagtcaatggtctcaaaaccccagggagagaagaaccttatctctggttaacctggaattgcaggcagtgaaaaatccagttaatgtccggtgagtttctggtagcttatggcatgcaatgacaaaacaactaattaccacttgtggttaccaataatgaggtttcaatgaaaggtaaatctttgaggcattgcattgatataatactagagaaaaattaaggtcatacaatttccaggatgccagaacgggtgtttgcttctaatggaaataagtaaaaatagagagggcacaggttaaagttcaaaatttttgactcaaggtataaaacttaggaactttccatcattacactaaaataatttattttctgctgcagctacagtgttgaaaatcaaatgcaaaagattgaaaatgcagattgtcaaatgcctttataggagttcacagaaatgccaggtcttccatgtgaaagcgattttgattaagaagggataaaagaatatgcatagttatattggatgatatcaaaagatacaatgaccttgatgtactttgtaccctaactctcactagcttcctttgccagctgaagctatgccatcttttatgtctgatgaggcagtttcatctgatttgaagatgatgaagaaaagttctttgcaaggtaagtcagttcttctgaagacttgcctgtacctcaatgtctgcacacatcctactagaattggggaatggaatatacatgtaagccagattcaaagctttaagcctaagaggaggagatttcaccacattcaaagttaaaacctaaaaagggaagatttcaccccaaagaaataaaaagaactggacaattattttaacaaaactttgggagatatgtgtgagaagatattctgaagtaccaagaaaggaagagcactacattagactgaatttaataatcaattcaatcaaagtgttttcttggccaaatggctaaaatctggattaaaacatggcccatgctaaagtttagatgcccaaaattccttggcatgatgtataaggaaataacccaaaggtaatgagcaatagaattgattgtgatcgactcacctatcctaaccatgtttgttaagagggttcagaagatatcctcttcaccaaggccttgataaatatattggtgagaggggtgttacgttctctgaaaagttctgcaacgttttggatgttgaagggggtcctgcaattgaaaatgagttccctaatgtcaatggggtggaaagatcctagagtagcagaagtcacataagaatattcaacaatcagaaaaaaagtggacgtggctactatgataggtaatcagaagggccttgcccttggggattgttggtagcgtaagagtacataggactgatggtgaccaaatcttgtgatgcctaagactcaggtaggtcctgagaatggaattccaaaatctaaatcagttcacaggatcagagctcttataataaatatagacttaaggaaggatgcatcagtaccataataagtacatactgtgaatctttattttaatcttcctcaaagaaacctatggtcttttaccaaatgattatgcactagggaatgggaaatacctaaagttttcagagcctattgcatgctggctccaagctaacaataattcctaggcacccaaacgatgactgtactccatggataacagcaggatttagggcaatcaggagataaatggaattgtgacccatcccccttcatgatgggattactgttatctcagctatattctgctattgtttttcaggttgcttattgaatattactgggaaaacaggaaaattaggaggaatgttctggagtgatttatctttttcatcaggggtgagtagaatttctgctatgctgtgggatctggaagtcatgtggatgaaagtcaagtgatctcttttggtcccctttcataccaccatgagtctagtcaaagctgatagcgggttaatacagccttataaattgtggatagctgaggattaagcatccttaggaatacaaatgtgtatttccaatgatacccatcaggtagcactgataagcaccggtgctaccatattacaataagtggagatcctgtacttggaggaatttagtaatttatcagactatggattgcctacttttggagaggagtagttatattttgggttgtaaaagggatatttgagtagggtggtaactcttttgagggaaaggtaagaataggaggaagggaacatctggctaatgggaaacatatatctatatgggaatagatctgtgattttttttctattaattttctaaaatttatttcttttcgtgggtatctgcaatgtgtggaagttactggaaagcagaggtcctttccccactaaagaaggccttaagagacaaatattttctttctatacttcttggcaatgagagcattggcatgtgatcaatgcttggttgttccttcgggacagtgcatcttgaggaagtgaccaagggacacatgcaatagttttatgcttcttgcctcactaacatccatgtgtgccaaagatagatggagtctttccaggcactaactacagagaataaaactatgatctcctgggaggtgtcaggagggtagtagtcatctggccataggagatccagcaatttctttttcatatagacttccattcctcctatcctcagccctcagactttcccctttttctttttactaaatctgatgcctacaggcctctctgggatttcttcagggtgaatcaactttattctcctcaggatcccaaagtggggataactgcacttagaattacagtgctgtcactcagctacctcagtaatctctctcctacacttctcatcttccaaaacttggttgaaatgtttcatctactgagatctcccaaatggtttatcttttttgacttgataaacatttcatttaaggaaattttggaagaacttcaggaggcagaggagaaaaatacatattggcaacatatcaagtttaacattgcaatcttcacaaactatcctctttcaatggttaggataagcatggcaggataattgtattgttaaaacatgtccagaagttaactgtgaataatatcactgtgctctaaagcatagggccacatcattattgaaagttgcactggtcatgatggtatagcagctcagctgaacttcctttacttttattctttcttttttttttttccagtggaagatgtcaggatgtcaggatcttccactaaatggggcaacttttgcatcagagtttgattgactactgttaatgtctgtctcaattttgatttctaattcagacaatattacaagaaaacccagtttagggacatgccaaaagtttcataggaaaaaattatttaattgagtttttatgtttgccaaaacccactcagttaaaatactttgcagacatttttttttctagtaaaattaaaagtatttaacgttcttccatatgtttcaggttgaaagttgatgtactaaccctttctcttcagcctctctaaaaagtaaataacctcaaaaattgaactggatgtaaaagtcatatattttcattctaagattgatacttaaggtcgtttccaaataccactactctggctgaatttatggccttttgatgccccagactgtttccttttgaggactctgaccaagagtctgatctttctatagttggcctgtgagatttgaaagggaaaagccttcagtaaaacatagagatggtgcttgtagtcaagggatacgaccttaggcagaaagaagggggaaaaaaagaccatgtcagtttctacttccaagaaaagctggttgctgttttgataacagtaatgtccctttagttcaaagttaccagctatcaaaacaagttgcagtccatagcagactaactcctttcccttacagagaagcagattctagtgtaactgactccaaataaaaatatatttacgataaaactaggcccatggatagcaagcagaaatcagaaaaaaactaaacttctgaaatgttcgggaaaaaaaatatcatatgctgtttatatccctacaactaagatatcattagaaaaattgtgttagaaggaaataaaattctaaaagacgacacatcaaggagacagggtaatagaaattaagtatctattaaagtaaaatacagaatcactccatcacatgtgttaactgttcagcaaagcagttctgctctgcagttggtatgaggtttgagcaggaagtattattgtctggcgtcagagccagggcaggatccagcttgaacctccaagtcatttcacaaggaaatatgaaattgcagaacagtgtgggtgggcaatggacatgacctgactttcatttattaaataaacacagacttgagtagttgtacttctgagaacattagcagtggcattgccaaggtatagcacttggggaagagggagttttgtcccttcataaatctccatgagcaaccccctctaagtcatccctcataaatttacaatctaagtaatctaagtaaaatcaagtgtgcttgctctgtaatgtagcttccaggcaaattaattagcgttcacttccaaaaaccttctcactcctaagtcctttctatagcgaaattcaggagctgccagtgttagtccaactcccaagattatgtgcaatgttggttcttgcacgaaccagagcacgaggggcctccttggtctccagttctcttgtatcattgtttcatttgctggcaacgagagcaggtaaagaaaaccatagtgtttgtgtagtataaaagatgacttcttaaagatgtgcagacagcaaaatccatgcttaaccaattgtaaaaataagaaaacctgaaaacaattactaatctatttatacatgtaaaaactggaaaatgaattcttagtatatggactggacagctctcagaaaattttttttcacaagcttcttggcggggaagggcatattctgcttctaggcagaaatgaagtcgttggggaggatttgcaagtgcgtgaagtggatgcacacgggtgaggcgtgcccattttaggtcaaatgcacttttctaaaatgtattggttaagaaataaaaagagtaccacagaatttcatcacatcccactattgcattttctaattatggtgtttgtcaatgtgactagtgaaaattcaatatttataaaataactacattctaagcctgtgatgcacagtcagtgtttgaatcagagaatttgtgagttaaaattccctcccatgtagatatctgtcgtcacctgaaagctcttaccatctgatctaaatatgtgaggcactgctgggtgctatattgttacattgagtgtttgaggttggaaataattttaaaaccgattgagtctaatggccacatctgcccaggagaggctgaaagtcttcttcagaatacacccatgctgacagagtgatagccactgttataaatacaaagtctgtgaaataaaaataaaatacatacaagcaattaggatagtatcgatatggtagagtctgaaaggtatcaagaaagctacaaagtcagacaggttaagcaaccagaattcattttcttgtttagtcactcaaaatattctttttctagccacaatgttgcaaccagttttatggatttgtgccctgatagtatgcaactctttgtagtctttggactttttttttaactgcaactggggctattgggctattttcataaactgtcacttaactgggcaaaattccagtccagatgctcctggagtgtttttatgtatgagacattgtctgcttattaaggcttgtctgtaatttcagttaaactgttgagtggacattgttgcttacagaagttagaagataccagagaaagaatggacaatttttgtgagaaacaagcaattctctgatgtttgagataatattaaataaatcaaccggagatgatgatggattaactaattaagggatccacgtagtctttacaaaggcacccaggaggtgcttataatatccttgaggatggatgtctttatgatgcaaacagtgaaaagaactctccttggaagaagacaagatgaaagaactttgtctaagttccaaatggaaatggaactcccccattaaaagttaaaaaaagtaaagaggaagacctagaggaagttcttcaatagagagtcttcggctttctctatctgtgagccattttgctccagggaatatgtttcctcataaattttatgaagagaccccgtgatctggcatcttgagttggcatataattgaacccactcacaggatcttaatatcctctgccaaaggagtcatcatctgaatgggaaaacctttgcaaaattttcccttcatcttacaagaatgactaattttagttgtatcacaaggaagcattttgttccaaacacagttcctagaaatagcggggcattccagtccaacagatgcaaaccttcctcatgagaaccaaaccagcatgcttgggcaacttgtcaatgaagccaaattccctgctttcaagaagattggaagaagatggggcttctaaaagaagagatagttcccacaactctgtgtgggttatctggattgtagaatattgacagcaaaatttaaatcccaggaggtctcttcctcatctctcttggaccccctcctttgttactcttctcactcgttaaatgaaagcatatttcatcatgaagctaaacaaaacttagttgaacatttaaatttattatataattgtgacaaagtaaaatataatgtataaattacacagttatgtatatgcaatgtgttagtaaattctgaaaatgtaaaataaaattttaaaattaaactttaaaataaaaattttaaattagaatttaaatttaaaaaaaatttaaatattttaaaattaaaattaaaaatttaaataaaattttaaaatctaaatttaaattttaaaagtgcatggcatattgggaacttcactgaactgtaagatagaaaatgagtcccgcttatggcttttctagtaactaatttagattagtagcttcatctttgtatttagtcatccgtataatgatagaatggacctaattaatctgtaacttatttgtagacctaaaattctttgattctgaatataacatgttcctctgccttgtatcagaaataatcatcaatatcagatggtgtttgctaagtgttgagtgagctaattagacaagggaaaagaggtcagttccagacagcatggcaagatagtttcagggaactactgggacttgagaagtgaacaggaatgtagtaagtgaattgcagagcactcaaggcattaggatgtggcataagttaatgtatggaggaagtaaactccagatgtgttgagcatcaggaagtagattaactggcatcatggagaattaagacaggctagcatgaagttagagaccaaattatggagagtattcagtgcctggatattcagaatttatgctaacaaatagacaacatcagacctttttttttgattgggggaggagttgggtaaatgggggaattacatgggcataagtttttgaaaaagaggaaaatgttactccttttcattatctatctgtttcagaattttttttcaaaagcatggacagctaagagttgatttcttcattggggcaatatcttggaatctcttagatttctatattagctcaaattttcttattttattgcttaacccaatttatctgattaattagaagttcattagggaattttttgtgtgtgtcacacattacttagcagttattaatttattcctcaagtatttcatgtgtgctgtgcttatggggttgggctgagttctggcaataagacagacacattcttcactttctgaagcttctagtctgtccatttacttttttgagtgagtgatatttcagaacttgtatttttgtatggattttgcatattttattggcagtggtaaataatgataatttttaaaattggcagtggtaaataatgataatttttaaaatttctgcaatatgcatctagtttaacagttatcagaaattcttgtttcctctgaggaatagtttgcagccaccccattccatatcatttgtgttaccaaatcctctatgttcataatgataaattccaagtatgcccatctaagtagcgatttttaaacttaaaccatttgatttgcattattcttcctggaataagcagatttgaactttagaaaatcctctggttcctttgggggaaagaaggagtaagcaggcataacagaggaaataaaataatcagtgggtcagggatgttcagtggagaaagtgaaaatggatccaccaattttgattatattttcaagactcataatttaccctcaggaaagttaaaaatgctttattagtccttttgtgatctcatttctcttgcaaatttcattttcaactaatttcccttgtataaaatgtgaggcaacttggggattttgcaatgtgatgtgattgtgcttagggatggtctgggtaccacgtttttaagtagaccgtaagagaagggtgacacttgtcttaatttagagatttttaacattttaaggtacttaaaaaccattataaaatttagtatggcgtttatagcagagtaatgtggtggaaactttttgcactgagagtccctgaactatataagtattcacaattccaggcctagaagtcgttatgaaatgaagttttacatagtggagactatcctgggttttaaaggatactttggaatctatctacttatggggttcatacaaagtcctgggagatgatccagcatatctgtaatcagtgcttttaaccagatttcatttacttaggagatttgtttactttatctgattatgagggaactgtatgagtcacaattcaaattaccaataatatcagacagttagattgagcatagctgggtcaagttattgttagtgctgggtgactctctgatgtgagcaaactgtgccccacgttttgactcaacctgctccgtacctctatgctgtcatggactgccatcatggacaacactatgccttgacagggctcagtagtggtccctacttttgacatttttctcctttctcttcttcaatacaagtctatcacttttgtgaactatgcattgttcattatccaagtccactggaaaactgaaacatgaacacaaactttgcctcctctggaagctttccctggcccactagctaggtcatattctagctgtcacacattctcctggctctctgtgcatctgcactgcccttttcccaggtataattagatattcatgtaagtacttctttaatgtacattttcccactgtactgtatgctctaagaatgaagggacactatattgtttactgttctatacccattccctaactcaatgccttgtgtatgtaggaggatcttaatcattttactgaatgaatgaatagaatttcagctagattttatataatagtaggcactccatacatgttgagttgaatactgcctcaattccatgtataagaccttttctcaaatgggattttgtggaacagtggttggaatttcagtcacagtgacagttccatgggagatataatgcctgctcggcatttgattagagctgttcctagtttccaataacaatacaatgccttcctcccaaatgtagtatccagtcaatgagagctcatgggatttgctttattccaaaccatgttaatttccctttacatttgtacatttgctaacctgatgtagtaatggctggatgttatatgaaattaaaaggattaaataaatctccttgcttcaaattcagaatgcttttggttaaattaaagggaaaattataaccgcagatgtaagccagtttgggtgtggagcaaccatgtgatggaaatagactgaactcctgtggatgcttcctgggatggtgctgaatgcactgcaacatggctgcggctggaagaagcagatgggaggcttctggagagttccttccatgcctcaccgtttgccatattggttagtcctccaccctgagaaaaagaagatggtggcatttaaggttatactctgcaaccagatcacatgaattcagagctcacatctatcttttgttatttgggtttttctgggcaagttacttaaactctctgtgcctcattctctttaccttcaaaaccagaatagtggtaatacccactgtgtagagttattgtgaagattaaattaaatttacatgtaaacacatgtaaagtatgtagaagagtttgctagggtaaatgcttaggaggtattatttttattatgactagatagagcatggaacttgagcaatggtgaaggctgacactaggcaaatgaaataagcctggttttcaaatgcccatcattctggctaaagaaacttaaaaatgggaggaaactcagcttaatatatgtctctcaactacttacatgaaatcataacatttggaatatcttatatttagttttaatatctctcttgagtaggcaggggaagtattgatatgtgtcctcagcagaccagggaattaaagatagggaagttaaatgttttgtccaagatcaaatagcctataagcagtggatcagggattagaattcagttcacttgaaattgtagtccaggacttttgtattacaacttggctactgctcaaaggttggcctcagattcaagactctttagctttttctgccttttttttttttttataaatctattcaccttgatcattcaaatgtacttaagactacccattgtgtggatagcactattgattgagataatgttctatatgacattgatttttttctgtccatatttaataaatagttactaagtttggggcagtagggatgtagaaataaaaaagaccttgttcttgacctcaaagaacttgtgttacagcggggaatgcagataggaaatgaaataaaatacagcatgatgtgtgttgataataaaggaaagcacatacgccaagaggatagagtgtagtatacaggcaagaacccagctaggaaggcagaggaggccgtggttaaagaaagacatctgagctgagtccatgttgaggttagatgttagtcaatgttaatactaaagagctcacatgaatggacacttttttatatgggaggcactgttctaagtcctgtgcatgtgttaataagtaacaaagaaatacagcactattaaaatggtgttataatttgaaatgcaaagcttcaaaaatatatcttgaatttgttcactctctcaatcttcagtgtaatcatcacctcttttgaacaatttatgtggccccttccactcttatccaagtctaagccacttcctacagagcagccagaattcatttcttaaatgacaaaatggatgtaactctcctacttgaagccttcactgactcttattttattcaaaatccgcacctttttttcatgacctataagcacttacattatatagcctctgacctgtttgcttatcttcagttttttttcatttctttccttttcatttgtgattccttaattttttacttctcccatctcttctctcatctcctactgatgccatttcacaagtcactgtagacagtgcatagaacactgataccataggatgctaatatatgatttaaaaaaatggattcatggttagataggtttggaaaatatacagtcaaatgaggacagatttttttggtttactttgcataacgttacctatctaaatttgcattataaattttgcattattctctaacttactcattaacaaaaaaacaaaatttaagatgattcttatatgaacacactttcagaagatactttgggaaatgtcccaccctaaagaaaaaccatattaaagagatcaatcttaagttggattcagaaggtcagcaaatgtattaccccaaaaatcttatatctgggagaaaagatggggggaacagagttaagaaaagttcatgaaatcctaagagagtctcctaagagactctctcttaggagattccgcaagtggaataccttgtgtattcaacaactagggtttctatcatgttctcaaattaggttccaaggattgaaattgagtcattcttttgagttaattaattccaatcagggtttattaaggatctactaggatgagtctttgactggaaagcttccttggcagagagcaccacgaggatgagagaattgttcctttcctgttttccaatcagatagggtggcactgtattgatatgagcttgggtggtccttaacacatttccatgaatcagaaattatatttgccaaatgctaatctgttgtaaaattaatagcaacatatgtgtgtgatgagtatcatttcatgggttttatctgtttacaaaagacggggaaaggaaattataaaaccatatagcataagttcataaagtaaatgaaagttatatagatttagtcagtgtatccaactctatattaaatgattttagaagactgagagaacacttccagagggctacaatggtttaatgctagtgtggttttgttctgtttttgtgttttactattctttgttaaactttttgcaattgtgtgtgctagaatttcagggtgtgaggagtaggttggttatcctagaataatttctcagtaatgaaagccttctttgggagacctcctttttccttctttttttttttttttttttgtttttttgagacagagtctcactccacccaggctggagtgcagtggtgcaatctcggctcgctgcaacctctccctcctgggttcaagcaattctcctgcctcagcctcctgagtagctgggattacaggcgctgctgccatgcccagctaattttcatattttttggtagagatggggtcaaactcctgacctcaagtgatccacccgccttggcctcccaaagtgctgggattacaggcgtgagccacagtgcccggtcctactttttccttttctattgtttttttattgctaccaaacacatctttgccaggcataaaacaataaatatggattttaaaaagggatgaacatttttgaaaacatatattcaaagagaatatattcttagaatatttctattactattagtaaggaaagaatatgaccttcacaatgaaacatggatgaactgtgtgtgtatgaaaaaaactgatgactaaaactgataactaaaagttaaaggcctgcagctacttaaaagacaatcctagcacaagttacgagtacttttgacttgcaggattcataaaataactaaaggaagacattgattagattggcaacagaatcctaggaaatttggttgagttcatgctgcctggatatacaggcatagaacagggacaaaagtaccttctgcctaattgtccatggcgattcacaattcagaattaactttacacaaaaaagatataaacctttatgttgccattgtgatcttaccatgaactcaaaggtgtttgactagaaaaatcccattctgtttgtgacttgtgaactgaatacgttttggacatttaaatggacatcttggtcattgggtttctctcccatgcacagacaaatagattaaaaaaaaattcagagaaagaaagacctgtacttatttgtgtttgctcaatctcttactttacaaatggagggtgtaacttgtcccaggcaaggatattgcttgccaggaacaaatagagccccataaaagcaatttgcaaaaaagtaatgtgttggtccagggaggcaatctttatacttgccaagaaaattatgggaaggattgtaagtaacaattaaagcctctgggcctcatctgtgaaatcatgtcatctacttcttccactaagtttctgtggggttcaaattagaaaatgtatgcaaaattaatttttcaactctaaataatttctaaatgctgctgtcttagcctacgtccctccagaaatagaccctgaatgaaagaatcaaatgcaaatggtcgtttgcaaagaagatcccagaaagctctggtaggaggacggggaagcaagaccaacagagactaggttattaagttgattactgctatggacaactgggggcccactcccactagtgtacaacacaccttggatgagtgccacctgaacagtgaggaagctggtgtagtctcctctcgcacttatctctgggccatgcagcccagagaaatctctaacgtagggagaaatgggtgcttgtagtaggcagttctgagggttcccagaatggtgaagagtatcccttgcatctgctacaattggttaacatcatgaaacagaagttggcttgaaagcaagctttaatatagctctagggtatgtctacagctgggccttttatagaatattattccagtgtaaagaatgaatccagggccggtcacagtggctcatgcctgtaattccagcactttgggaggctgaggtgggtgaatcacaaggtcaggagtttgagatcagcctgaccaacatggtgaaatccatctctactgaaaatacaaaaattagctgggtgtggtggtgcgcacctgtaatcccagctactcaggaggctgaggcaggagaattgcttgaacctgggaggtggaggttgcagtgagccaagatcatgccactgtactccagcccaggcaacagaacaagactctgtctcaaaaaaaaagagaatgaatccatatttggggtgaatttagatgattattttatgatgggtaaatcattgtgttgtgcctctgtacgtggatatgtgcatgcatgccttatcttgtaagaacttattttggattattttattaggttggtgcaaatgtaattgcagtttttgccactgctttttttatatatatactggctatgaatattatttattctattactatttatatacaggtgaaagaaaataactttctcaagcatacacattctttatttttttaatttaatttaagttttaaaattgtactttaagttccaggatacatgttcaggtttgttacatttggtatacatgtgccatggtgttctgctgcacctatcaacccgtcatctaggctttaattcccacatgctttaggtatttgtcctaatgctctccctcccctcacccccgaccccctgaaagacccttccttgttgttccactccctgtgtccatgtgttcttattgttcacctcccacttatgagtgagaacatgtggtgtgtggttttctgttcctgtgttagctcgctgaggatgatggtttccagcttcatccatgtccctgcaaaggacatgaactcattcttttttatggctgcatagtattccatggtatatatgtaccacattttctttatccagtctctcattgatgggcatttgggttggttccatgtctttgctattgtaaacagtgcttttgccattactttaaatggcaaaaatcacaattaagtttgcatcaacctaatatttgagagataattaaaagtaatgctagcccggtgttgtggctcttgcccgtaatcccagcattttgggaggttgaggtgggaggatcccataatgccaggaattcaagaccagcctgggcaagatggcaaaacctcatgtctacaaaaaaattaaaaaaatatagtaaggcatcgtggtgtctgctattcaggaggctggggcaggaggattgcctgagcccaggagttcaaggtgggaatgagctacaatcacaccactgcactctagtctgggtggcagagtgagaccctgtctcaaaaaaagaaaaaaaaaaaagtaatgctaaactattttattttatttaaggtgattattcttaaattacaaaaataaataaaaatacactgcatgccaatgacattcatgattatttttacagtttgataatatataaaagtgtcttataaatatatcatcttaaaatgttttctgcttcttagtatggttttatattataaacatgtttaaggtaaacatttttgttaagtgtagcaatatatgttattggtacaatgttacgttgattactgtattttaaactatattgcatattactacaacaggttttgaatttattggaattgttggggcaatggagacatttaactttaaaactatcttttaatatgaacatttttataatgtgtcagcatgaactcaattaaaaatctatgatgacacgaatttaaggaaacatattagtaaggacacagattttggtaagaatggctcaaaagagcagtttagaccagatgacaggggccttttcttttatattctcatctcaatgtaagcagcccagggctcatatggcagctgtgtgtgtcgggggtcaggctcttatgtcttgttgctcctccaatctataggcagttttcctcacctgtatggtttgagatggctcaccactttgtttttgtccagccagtgagtaggaggaaagaaaaggagagggcatacttcttccttttaaaggaataaaccagaagttgcatgtatcagccgtactcacaaactgatgtgcagaacttagtccctgaggtcacacctaggaacaaaggaagctgggaaattgtgttagtcagtttgggctgctataacaaagtaccacagacatagttctggaggctgcaagtccaagatcagggtgtcagcaaggatgggtaatggtgaggactgtcttctgggttgcgactgtcaacttcttgttgtatccttacatggtggaagaagtgatggagctctctgggatcactttaattagggaactaatcctattcatgagggatccacccttatgatctaattacttctcaaaggccccatctcctaataccatcactctgggggtctgaattttaacgtattaattttggagggacacaaccagcccattgcagaaatgtagtctttcttgctgtgtcaggagtttggctaaaaattaggaggtttattatgatgagaaaattgacaactagaatttgtcagggtcttcctatgagtcagacaaatatccgtgtacatctttttttttttttttctgtgcacgtagaaaatactcacctattcctcaagagaggagaaacccatccaattgtttcaggttcaaaatcctggaattttgagtgctgctccatcctatctgctatgttcagggtgactctagcaatttatgggacaatgacccacaaattaaaatacaagtcatctgcatcccctccaacacccaccaaatactcaatattaaatggtaatgatgaactgaataactgcagcaaaagggaataatggagattgcatagcgagcactggtctgcagtgattatccaatcttgctggcaggagtgaagcagacttcctgccctagctgtggccttctctccctggtttgctggtgacccggacaggttggaggtctgggtgttgctttaggcattacaattcccataaaagccaaaccgacttctagacttttccttctgactggtatcatgtattagcaagcacagccaattatggcttctagatatcagttttaagtctgaaatcactgatcttttatttatttggctctaggcgccctccacttaatagtaactacttggaggtcatcatggaaaaaaaaatagacttgtgtgttaaagtcatattcttcatctccttttggtctctgggctggttctcctcatctgttagacagccttagcaggaggtgcttgagaaaaacttcacaatgcagtcagaatttctttgaagattgcttcttcagtgctccttcttttttttttttcttttttctttttttttttttttttgagagggagtcttgctctgtcgccaggctggagtgcagtggcatgatctcggctcactgcagcctccgcctcacaggttcaagcagttctccttgcctcaacctcccgagtagctgggactacacgtgtgtgctgccatgcccggctaatttgttttgcatttttaatagagacggggtttcaccatgttggccaggaaggtcttgatctcctgacctcatgatcccccgcctcggcctcccaaagtgttgggattacaggcgtgagccaccacgcccaggcttcagtgccccttcttacattttcttacatttgtgagtgtagaaatcatttttatcattatttcttttaaccctatgatgtttcaaattaccgaactctcagtcaacttagatttctgattcaggccccaacaaagtgagtctctctcagcagatctgtgttctctgcaatatctgcttgtagactggttagatctagcctaggtctatctctcttgtgacactttgttgaagtggtaaatatgtagtcaatgcatagcaagattctaaattttcttaattgtttttttcaactgtaagttttgttaatatagtggtaaatataccatggaatcacaagtgacatatttgtcaaatgatctgccataaatacacaattatctctagcttttcagcttgcattacttgtgccatggttgttttctacctgattgctaatccaatgcttgagtgttcacttttgtagaaatattccacttttggaacaaaatgtatatgttatgctagagccttgccttgaatagtggtatattaatccattttcatactgctataaagagctacctgagcctgggtaatttggggggcggtgtgtgtgtatgtatatatatgtacacatatatatgtttaattgactcacagttccacaggccttttaccatcatggcggaaagcaaggcacatcttacatggtggtaggagagagagagagtgaagagggaactgccaaacacttttaaaccatcagatcttatgagaacttactcaccatcatgagaacagcatggaggaaactgctcccatgatccagtcatctcccacaaggtctctcccttgacatgtgggattacaattcaatatgagattcaggtgaggacacagagccaaaccatatcaagtagagaccaaatataaggtggcttaattaagagaggactctgttgaacagtctagggctgtgcctttgtgctctgctatcccgaagttagtagctcttgcctggatggagtgagatgactgaccctgacacctgtgttccagtggatgggctgggggttgcaggaagggaaaggtagccccagaagatgagcacttcatttctttggccactctttgtcatatgaccactcctagctgcaaggaaagctatataaagtagtttttattctgtgtttcacttatctattgctgcatgacaaatgactccaagacttaatgtgctcaaataagaatgatttatttgctcatgtttttatgagtcaactgggcattttttcagtcccatatggtactgacttggtcaatggtgcagctgcttttacctgccagttgggctagactagaagggacaaaaggcctcttatctgttggaggttttggtgcttttagcttggttctcatccacgaagtttctctctccacatggctttcatctgtcagggactctctatgaggcctctttctccagaagaatagccttcttacagcctgaaagctgcattccaagagggtgaaaggaaagctgccaggcctttgaagggcgaggcctagaactggcatagtgtcatctctgccatgtattttgatcagagcaagtcacaaatcacaactgcagcccagattttaggggagggaattagacttcacttcttaatgggaatagtgacacagacaaacatgaaggggaggaattgtaggagactatctttggagactacctaccatattccagatggttatgcagtgataaaaaccagggcattggacaggcatagtggctcatgcctcaaatcccagcacttcaggaggatgaggcaggaggactgcttgagcccaggagttcaagaaaactctgggcaacatagcaagacccgtttctacaaagttaaaaaattagctggacatgtggtcatgcacctgtagtcctagctacttgggaggatcgcttgatcctgggaggttgaggctgcagtgagccatgatcatgccactgcactccagcctgggcaacagacagagtaaagccctgtcccttccaccccctcaaaaaaatcaaggctctatgtttatgaaagaaagaggaagaatagatagtaggagaaatggagcagcctctgcagaaggctcttgcattttatttaagtaattgttcctaaaatatttctacattttcagaaatcacatattataataggttctatattttaaaaaatctttacaaatacagatttgagaattaatgaaaattagcatcctattgatttccagcttacctgaaagatatttatgactatgtatttttgtagaaatcattcttggcagaatatatcactgactattgttttttaaacctatttctacattatacataataaaatgtctcttctgatataaccttgctttctctttttcatagaaatatttttgggttatttttatatcaacaggatttctttggtatacaagtctctacttttaatgtttatagacttatggactcttgagattgggatggaatttacatttatttcaatatcttaattacgaccataacaacagtggtaattagtatttgttaagaattcatgctggtcaatggttatctcatttaattttcaccagaacttttgtggattaattaccattgttaccttcatattatagtggaaggaagggagatttctgagggttaagcatcttgcccaagattacacggctagtatgtagcaaaggtagaaattcaactctggccaactgaccacgctcttaacttcatgctctggagatctttctctagtctaactcatctgctgagaggttgtccagcttgtgtgttaacacctgatggggaactctcttcttcatcagggtaatgaatttcagctcttgaatttcatgatagaaataaatgaccctgtctctctgcagtcatgcattggttttagccaaactatttgggctcatgaagaaaatgtcttgcctgtgttttccatgacagacctccaaatatttgacaataattatcactctggaatctcacattctttcatcccgcactcaagtcatctcctctctaattctatcagcagattcttatatgatagtcatttcactcttaaccatcattcttcttcaaatacacagcatttatcagtgatgcttttttggcaagccaaattgatggaatccaccaggaatgggccagctggtaaagattacaacacataaacaccttcctccttgtataggctgcctaataggtgatagtgtgtgatggaaagagccaaggctttggagtcagacagacctgaatttggctggtgtttcactatttctactccttcctagctctgtgccttagggaataggcttcatccttatttttttttttccatgaggaaggtagggatgggaaatatccaccttagaaggtgtattaaagatgtaaggtgggcatctggctctatgctcggactccaggaaaatatgctgttttattattgtaatttttagttggccatcttgcacatttctctaagtaaaaggcatatgcagacaagtcaagaatgtgctcagccatttcaggatactgttgctaggagagtttgtttgttgtgaaggtaaagtacacttacagttcttcatgtaagtcaaaactggggtcagatcagcctaatttctgcacaatgttcaggaagactatcgtcttgaatttggctcatgagaaatcttatttctagacaaaaatttgaagcaagatttttctttttgttggaagttcaatagactagcattttgcattcagcatcctgttgattctaagactccccagcatttaaactttcagggatattttatcatccagcaattaaattttgatgaatttgtgttctttacagtctgttctcattcattgttttaattatgcctgtttgtgtttaaatctgttcatgtttaatcaaaaggatggcctcgtttcatttcaaaagttattatcaacctcaaaattgtctaataaactgtgaagtaaaacaaatttgtcatttttcatatttatggaaaagacatgatttagcaatagtattaaaggcagaaactttaaaaaaaaaaccatgtgcagaatatgacatttgcttaatgctttccttctactggcaatgtttttcaggagataacagcacagaccatccagaaggaacttaaagtaatttaaagtgatacctgtgaccctctaagtgcctcctgctatggtatttctgcttctgctttgccagggggattcatacacagaaatctgaattaaatgagagaaattaggcacccattaaatttgcttttcagagagaataacagcaccataaaaagtgctgtcacagaaaaaaatgacatagcctattctgtattgatatgatgatatagattaactcctttgagcatgttgcatttgttattttgacaacttttctaactatgctatagaatttaatttgtaaaaagatgtgaatttcagatactcccaacccccatgctgacatttttggttctaacaggtgaatttctcaatttctgcctttgtgagttcttgccttcaaagtgacttcattattctttattttgattagtcaagctgtcaagatcccaaattaaaacaaaaatggattcagaattctagcatcatgcccaccatctcaacactgtattatggacttttttttttctccaactttacctggcatttgtattgtcctggccttcccaattctgctggtaagcactaaaaccatagctccagatgagaaaatgcatgcctcactgaggtatgcctgtctccccgtgagaatactacctagatcatgatctgagttcttgtgcagataacttttatggcaagtccgtattaaatcccctggtgcaagaacaaaagaagaatagaagaatatagaatggagaagcttgctcaaactccagagagtagggaaaaaaaggtattaaaaagtaacacaataaaacaagcacattggcatatgaatttgcaaacagtaattttcctacctgtggctgcagagctgcactgtcctatcacattcattacatgcccatgggacttttgtcctgtgttcacagttggctgatagcagtataaagaaggatggaggacagactcactcacttagcgtctaggagtcaggtgggctcgttcctgctcttcctttctgtaacctgcaaccttgtatgattctcacagaactggtattgggttcaccacgtataaaatgggagattggtcccatactctttccttgccatgttgacttggaatgaataatggcaacggggtggctacttgacagagttagaacctcttcaactcaggtgcttctcatagatgccaggcactggaattctgatgttgttatatattcctgacctaatggatgctgggctatctcctgctctccttaactccttatgcctcttaaatttacttgatcatcccagggttcccacatttgaatttactaatctggtaaacattttttatgctaaagcccggaaggtcattgaaggttcttctgctgctgtctccgatagccctacactgaacaaagtgcattttaattgctcttctctagataatatacctgcctttgtagtctaatttatcaggaatgctagtttaactcagagtcggggtaagtattactcgctgttatcatgggagacttttggggctgttatgaggagtgggaaaaaaaacagtcagctactgtctaactccacatatagaattaatgatacactttgggaggctgaggcgggcagatcatgaggtcaggagtttgagaccagtctggccaacatggtgaaaccccatctctactaaagatacaaaaaattagccaggtgtggtcgtgggcacctgtaatctcagctactcgggaggctgaggcaggagaaatgcttgaatccgggaggcggaggttgcagtgagccaaaatcgcgccattgcactccagcctgggcgacagggtgagactccatctcaaaagaaaaaaagaattaatcttgatagtcatactcagtgtataaaaccatgaccacagtttgttttgaaaaacagactctaaaagagagtacatgctttccttgtgtgcatcaaaagcttgctcactattgttaaaaccaaaaatagacttggtgtgattaccagttattttattttcattattttgagatctaaaacattgtttctaaatatctacttgtgtaagtaccaagcgattggtaagagttctcaaaaagttccctttcctcagattcttgaaatctctcctttccaagagaggtctaaaaaacatacaggtttaagatttccatctaatagttttaatttaaacatgtctggagtgggaaggtgtcacacaaagtaaatcagattaacttggagtaacttgtgttgttatacagaacagggttgattctcaaaagcatccttgtactaggatggtttagaatgaactgtggagcatgtcttgtcttcagttatggaccagggacaggatatgtgggcgttatatggcatggctttggtggattatatggcatgtgttgagaccttctggatttcatgcaaaatacacttcgtgtagatacagagtcttgttgaggagcaggcacagagatctgccctatgtttatagcactaagtgactgttcatgggctgcccaatatattttagaggtatttggcacaactcatatttttattagtttttggaagaaactggctttccctttgttatctttccaatgccaagtttgaattgaaaatgaacattacatcagcttgtttcttggtcattgggaaaaaatcccgtctgtacagacaaattcaacctgagtaccaagggaagaagagacatatgatgtctgttgaaaattgtcgtatcaagttttacacattttgtttagaatacagtattgtccctatccaaatcttggacacacacacacacttaaattttaagttaaaatctgctctacatacacaagaataaagatttttgtaagcatatccttgtactgtttgcaaaatttaattattctgtgataatcagctaactagtcatgtttatagtgactgaggaaatctcacaaggaaagcactaaagcagggtctggaaggtggatttacatggatcccttattacacctattcccatgattgcacattaactaattttgtattacatatttgtttcagtaaaatataaagaaattattatttaattggctcagagatttaaaaagtactgaataaggttacattcttagtagtgtaagataaccaagaagacgatgttcagatcttctgtgacataaattaccattgttttgctttcccacaacgtgaacattttttaaatgctggtttgagaaccaccatcacaacaaaggatgttaatgtgttaggttttttcttttaatataaaacagacctacttgcatatttttttctagtttagcagttattatgcatctactgacttggttagctactgaaatcaagaatcctttaaaccaagagaaaaggagaaaatactaaaaacaaaacaataaattaaagagctctggggtgtgtttggattattttcttgtcatgattcttgggtgtggtgacacttgttggcttttctatgtggttttattaaggactttgtgtacatttccatgttgttcagcttatggcgtcttgcctttgttgtacccggagttcattgtgcatgtaggatgaactttctcacagtcatgcctatgtaaagtgccaaccaaatggcttggctgcttcttctatatctgctgtacctacatactctcaattacagtactaggcaagagcataggcaatggaaagttgtctttataggattttccttgggatgagttttgtagcagaataaatagcagataaaatagtgcacatcatacttgggcaatgtaattactgtttatttgtgaagataattaaaaaaccaaacatttgctcaaggtttgaaaaacatttgagagtgaattgaggcagtcagttactttctgtccctgaggtaagatcactgagcttaggttaagatacctcacaagctgatttggtcttctttcctcggcttcacttatgtggctatagcttcaggaatctgagattgtcagaataattagttgtgggtttgtttgcttctttgttttctgaaagtaattttagaccagatggctagtcataaatttattcactcattcaagaactagtcatttagcatctatgtgggtcagttctgtgctgaacaattgatatacaatggtgcacgatcttccttgtcttcaaaaaggatgtagtctagtggggaacatagaccactatatacacaattgtaattcagcgtgctaaggattaagtataggggccaggtagtgttaaattgggtgcacctgacctatttgggtatattgagagaggttgcccagaagaaatcatagtaaaactgagacaaatgctagtaattaacaagcaaaagaggtaaaataaaaagaagaaaatacggagtattcaaagcagagggctcacttttgcaaaaagtcagagttagtagttaagattcaaagtctgccatgctgtcctggtgaagttctaataacaaacatacacttccttcccagttttccttattgcatggctcagaatgaactcttatttcatactcattcttactatatagcattgcctttggttatcacaaatagtcaccaggcttttccctgaaagtaaatgggtttcattaggagcagatgtaattctaatctgtagagtctgtaaaacattcaagggattatttggattaaagaactctaagttttaaggggaaaaatattatcattattttaataatactttcccaagtcgcaaacgaataactggctccaacaatcacatcactgtaattgttcacacatttcaggcaggcattttacagccacacaaagaaacttcaacagctaagctcctctgatttgattgctagagagactcaaaatttctgttttagtgccaaaaatcgaatcactagagcaaaagttagacaggaaaggctgaacttgaacaaaagttcagtggttttataaagtgtgctattattgaatctcatcaaatttaagatgtattagttgtaatgtgcactattttatgtaacattaacaataaatacataacacactgccatttaaactatgacatgctatcagctgtaagaccttctcctgtttaatttcagagagattaacatgtgaaatgatgtctatcttagaatctgtgaatcatggctaacaacaataaatatttctatgaagtctaatgggtatttcttctatatgataaaaaaatcaaaatgaaaaatagaaaatcaagtcagacatttgaaggctttgtgtttgagattggaagtgttggaaggaacatgatagaaaatagaaaattagaccttaaaataggcattccagtctcttgagcacattaaaaatccctattacttaagggagatttgctatgcactgaatctgaaaaacagaaggggtaggaaaacataaagatattgtcagcttcctcttacctccatcaaacagaatcatagtgtcattaaattaaattcttttgatcttcagcactttttgaaagatttttgtgctctatggttgtaaatgtatacacataaaactaatagttatggtagagtgactataggaaaagaaataattagtgagaaactttgggaaaatggtggaagaataaccaaaagatagaaaatgtgaataacttttacttatctgttactggctattgagcaatagatgaagatgagctgagtaattgttcaagcctaatatacaacccctgccttttaaagttttgctagatctcctttcagtattactgaaggaatcaagtggcaactgactctaagaagataaggttgtagtcccaaacaaaataaagcaaggctacaatttattcctaaaccacttttccttaccttccactgttaccttttacatttccttaataatttgatactacttttccaggatccagccacatgcccttctgccactgtgacaaaaagctaaattttctctttgctataacaacttaagtgttacaaaccaggttttctcatgagacaaaaggtaaatatttctaatatggaaagagtttctactgttcataagaaaaagaacatagtacgtaaatgcacacagacattgaacatggagttgacagatgaagcaatatgaatttcgaatagtcatatgaaaatatcctagtgatcatcaaagtatattgtatacctataagcagcaagactccagtttttgcctgtaagataagcaaaaagttaagatgattgataatattcaatgttagtgtgtgggtaggagtagatattggcataactgttttggaaggcaacttaatgtttaattttggaatttcaaacttcatattgatcagtaaattcacttttaggattctgcctgtagataaactcacatgagtttacatgaatatatatattgattaactgttgaagcaatttttatgaaaactaaaaagaggggtctgtaatctaaatatttgtttacttaaataatttttattgaaataaaggtgagaatatatacaggatcttgggcggtggccagtggccagaccttctgctcaggtgcctgaaaaggaaaagaaggtctggtgtacaaatatgtgaatggggaaatagaaatggcacacaatgtgggaacttatgactacccattggttcccactggaaagtccccaaagtgtccccaaagaagagacactgatgaaccaagcagacaagatgactcagccagttgacattatccagcctctgtcattgactactccagaactggaatgagagacacatgaatggagttgtcatgatggtagcgataaaggccacatgtgaaccaaacaatatgacttccacttcccaagtctgctctggctgcctctgaaagttagcaacagggaccaacactgagcccaagatatggcactattacttaaggccaaccagatactctgtggaagtcaaatacattgggcctcttctgtcttgcaagggccagcagtttgtcattgcaaggatagaaacttattctgggtatggatttgcctttcctacctatggagcctcaactagcattattacctaggaacttgtggaatgtcggatacacagacatggaattccacgcaggatagcattcaacaagaagccctttttaacagtgaagggggtgcagagtggacctatgaccattgatccactcatcatatgaggtactgcattacctagagacaaccagccttgaagaatgcttaaatagtcttctagactatttaaatgccagcatgcaggaaactctgaatggatggtgtgtctatcattctacaagacatagtgtatttattaagttggagacccctatatgatgctgtaccctcaaaagaaaggtctggaaattcaagggctgagcaggagtgacttcacttataatcacaacaatgacttactgggggtcctgtcttttttgtcactgtaactctgggcatactccacattctattgcctttcagaagcatatgggccaatacagaagaagaataattatagaagtagaaccccataaattagttttctttttgcaaacactcatattacttggaaacttatgttttcagtgtaactgattctgagttcattttagctggcaataagtagttacaatttttttaaagctgaattacatggtttaaagagggaaaggaatgccaaggagactaatacagtaggcccatgagttctgcatctgtagcttcaaccaaccatgaatggaaaacattgaaaattaaaacctaataaagaaaaacactacagcaaaacatagcaaaaattaaaaaatacagtataacagctatttgcgtgacatctacatagtattatgtattataagtaatctagagatgattcaaagtatacaagaggatgtgtgtaggttataagcaaatactacaccattttatagaaagaatttgaacatccatggattttgctctttatggggggtcctggaaccaatccccatggataccaaggtacaactatatttatctagggttggtcatggtagatattatgctgaacatatgttaaaaatgccttttatatccattcatttatttaataagtggggtaaaaaactagggtgctggggattacttattaacaagacagacacattcctatccttacagagcttaccttttattgtaggggtatatattattaacatatacacaataagtaatataatgctcagtaaaaataaagctgggaaaagatgatagccagtgaaaggtagcttggaagaatgctgttattttcaatatagaactctctctgagtagatgaagtttatgtagagacctgaataaggtaaaggactgtgccatgtgactatcaagggaggagggaataggtagaggggacatcagtcacaaagatctaaagaagggaataaacagcccattcaaggatacctaagaaaaccactgatgaatgggcagaagaggcagaaatggggttgaggaggtgggtgaaggctgacttgtaggcttgggtagggagtctggattttattctaaatatgttgggaagcccttagagagctgtgcacataagatggatgttatctggtttaggttttacaaattctactctggttgctgttgtggagaatagaacctaatcagagaccaattaggagacatttatttatttatttatttatttatttatttatttattttattattatactttaagatttagggtacatgtgcacaatgtgcaggttagttacatatgtatacatgtgccatgctggtgcgctgcacccactgactcgtcatctagcattaggtatctctcctaaagctatccctccccgctctccccaccccacaacaggccccagagtgtgatgttccccttcctgtgtccatgtgttctcattattcaattcccacctatgagtgagtatatgcagtgtttggttttttgttcttgtgacagtttactgagaatgatgatttccaatttcatccatgtccctacaaaggacataaattcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggcaaggacttcatgtctaaaacaccaaaagcaatggcaacaaaagccaaaactgacaaatgggatctaattaaactaaagagcttctgcgcagcaaaagaaactaccatcagagtgaacagacaacctacaaaatgggagaaaatttttgcaacctactcatctgacaaagggctaatatccagaatctacaatgaactcaaacaaatttacaaggagacatttagttgcttgagtcctggctgagagataatggtcagtggcttggggttagattttatgttaaggagaaaattctaggcttaaatgtgacctttgtaaacagcaacaaaagcaacttctaggattgttttggcaatatcttaggtctgttaaggtatcagtctgctaaaactgatctaacatatgcacagttttgacactatacacatatgggcattttgtagtatttctataattctcaaatgagtttgtaatcccaccaaaaatgtataaaacacactgtgaggaggctgtaatatccactaaatggtaatgatttctgagatatccaagatcagatttggaatcttctgatatccaagatcagatctggctcaggacaaattgcagggagcatttcaaaacaaagccctgtaggtcattatctccacctcctcctctttcttcccaactgtaggtcaaagcttatgaaacacagtatgatttgggaacatataaagttgcaaaagagataaagggaacccgtgctggcacggtgacacccagagctacaacagcagctctgaggccactgcagagcagccctcgttgttgtgtgccagaaacaggagcccctgctgacccatgcaagaccttcaaaggatgccagatgactgatttactgtggtttcagaggggatccaacagagagcaaaagtttagcatacagctgaaaatcacatcgattttctcagctcactgtagtttattctttccagtggatgtgtttatgtgtttatccctcaaatgaaataccctggagctacatatgtacaatgctgaacatatctgtcagtggcctggacagtaaagaggaccataaagccatttgtatcattattcaaatcacattttgctttttactctgtagtctcaggtcatttattggcctccctctgcccagtttacccaacttgaagtaggtataagatcacaatcaaaagagaacaaacacaggttgttgtgaggatgaaacacaatgtaatgtttataataaatgtgtagccagttcttggccacagacttagaaggtacttgataaatgtttctgttcttccttctctcctgtcctcctttcagctggccattgtaagaggctgttctcagttctgagtaagtcttgttgacaagatggagcctgccccttgaagtttggtcgcttacttgcaggttttatggtctaatagggttttaaaactgaaggggatcttagaaagtatacagtcctcatatctcatttccaaatgaggagacagcagtgcagtgagtgcaggcgatttggccaaagttctgcagatactagaaggacatgtgctccccgggctccatgtatcacacactctttctgttggcaccatattctctcataccctgctgctcagttgtgcttgtgcaacaacaatgtgaggctgcctgaacccaatggtgaagtttgacagaaagaatatatttcctttgcttcatgagattcacaataaagtgagcctatttgttgtgctggccttacacataactttgttgacttattttactaaaagttccgggtgatcctttcaaattctgggaacttaaaattatttggccaggactcaaatgactgatgttgtctctaaattgtgcttgtgaaatcaaaaaaggacattggtagtttagcacatcgcttgtgtttagaatgaggtttataacatctctcttagtgcaacacagaaatttgacacaataggcaatagtcttgctctttagatacaaagttaacttcctgtttaaaataagtagtaagcaaatgctagcataaaaatttaatgatatctttgctataattttaagtaattgaaagtatcctctacttctgtgccctgagacagaagttatgaaaaatgtgtgttagagggaacttaaaatgtatatctaggttcataaacccacaagcagattaaagtttcttgatctgtgaaacatttccagttttagagacacagtccctgagtcccttgactcccaaaatactcctttggtctctttctttttccattgcactctcacatttacttaaaatagacttagtagtacacactcctctactaactgaagacattttctttctttctgaaaatatctatgaatctttatgtggtgggtacataatttttgaaaatactattgtaatgtgatattttacctggtcattttgaaagagccatacaaaatttatctacaacatttctaaaaatattttcttggcagtaaatatggggtagggaaaaaatttgtgcaaagccttgtagcaatttgctaagcaaattagaagtctttgtagatctattacatggggaaactttagctctgagtaaagggagtacatttctcagggaaggccgtgggaattgtgaaatgtgtacttgagtctcagaatggggctgggaaatatttttgtcaagaggacaattgcccaagagtcccatagctgacatttgttctaagtgtgagtgtgtctgcatgacatcagactatctggattcatagcaaagaattccatcagatgtctggacgtttggggttggaaaccactttgctctctgtttgctaaatctgttctcccatccaggggttcctcatttcctataagtggaggctcaggcctgaccactgtcagaggctgcatagggccctccgggaccatttctgagctactgtaggagttttgctcataagggcacttacactgaggcaggagaatagggtctgcagagagggaacctaaggctgtttcacgctgacttcctagaactaaattgaaaggaaaaccctgactttccacgcctaagtaacaaaaggaccagaggctactccctttgcaaatcccccaccttttctgcgcgcagttgagaaattggcagtccgcaacaaatcggactaattgcgggtggaatcttcatttgcatagaagtataactttgtaacttcaccctagcctctgattggttgctttttgcaaccaatcagatgtttgcacaggagtgcgacctctgtaacctcacttcagcctctggttggctgctttctacaaccaatcagactgattgtgggctacaacttcatttacataaagtgagcgtgaagtggccaatgggaaacttatgggaggtattttggcccaggaagattctgtatcctgcccttgagctgctgcttgggcctgttcccacactgtggagtatacttccattttcaataaatccctgctttcgatcttttgttgcttcattctttacttgctttgttgggcgttttgtccaattcttagttcaaaacgccaagaacctggacagcttgcagtcacgaccctctaccagtgacaacacctcctgctatttactattcaccactcatgcttcatacctcaattctgatatcttgtcacactttttggcctaatgtcctgatcattcagggctcaaattcttgtagagagtctaatccttcgttcccttggcctggattcatgagcccacaacctgactgctcagattttgtgctcacattcttaagtctgaatcaatatttgtttgttcactgccataaacaatgaaatcttcagacttttgtttttgtttgttttttcttacatacatagtttttctacttgttgttttggcccttcctgtttagttttctcctattttattcaattctagtgagacagctttacctacacaaagccaacctgctaaacatttgaaaatattttgttgggtatagtgaataaatgaccaagtgaatcttttatctattatctatgtatgtatgtatgtatgtatgtatgtgttatctatgtatgtatatatctgttatgtatgcatgtatgtatgtatctatcatttatgtatgtatgtatgatctatgtatgtatgtatgtatctgttatgtatgtatgtatgtatgtatgtatgtatctatctatctatccatctacctatctatctcatctatcttttatagttttctggcacttgacattcaaggccctcaatcaaccttcttcctacatgtaccgtatttccatttctcttctttccaccaactcctctctggcaagaatactgttcatcaatctcagtgtgcatgatacccttgtttccccaaatgctggctcacaaggcttccaatgcctttcacccaacttatctccataagttttatttctaatattctttcaaggcaaaatgtaattcttcctttttatacaaggattcctgaaattgtaatttcttcatgatctgtcttccaaatacctggtggctcttattctctaaattacttattttactaagtgccacccagtatagttacagctctatatcagaagccattttggtagaaggaactgtcttccctactttgggcttatattatttatctactatgttctcataacagagttggtgctcaatgggctttgttaaaaaatcacattaacagtttttttctttgtatacagagattaatgccacaaaaatggtgaatatttctcaaacctaccaattttcaagataactccactttagactcatgagaaagagggatcattgattgaaagtagcttcctacagtgggcatataatcattaaatttctggaagaaagctaaaaccacacagaaaatcatcttgaggcttacacgcattcagtctgcctctgatctaagaggatgttggccattaggagatgaaaatgttttgagctaggaagaaacaatgtaaaaggccaagtggcctagtttaaagtttctttgtttttctttataataatgaatgcaatagaaaagtgttgaggttataaagtttttaaagttcattaaagggaggggatcaataaattaaaatggcaaacagttgctcttaaacatgtctttatggaaattagagtagtgtgtatttattttgctgttactaataagcaatcgatgttgtgcttgacttcttgagcagatgtaaagtcatcatgagatgtttccttgtttctgtgtggttcttgtgtttaataaaatggtgacttccttttgttggcatcagttctgtaattcagatgatctttttactgctttgtatccatccaagttgtgaaatcaactataagctgctcctttcagcttgccagtgatgtggaattcttaccatatgaacgttccccagggtttttgtaagcctctttaacctctggatgcactctattgacagcttccgagttgtgataagtatctaccttttatttcaacttggagatttcttgaacttataaaattacatttgctttggaacaaatactttagagtgcactgagatggcaggttcatgaattccccagaactttcataggaaatggagaatgcaaaggtcatgtaaatatagttgtagtaatgtcttcactgattgaaaaaaaattaatatcaaacacattttagtttggaaagattgccatcagagtggacagcatagaaggaatacatatgtgggttatcttgtgggatgtggttcaaaataaaactatattttcagatagttgatacttcctaaatcagtatttggatcacatcataaatatttttttaaaaatccaaaaaaactctgtgtgtgcatgttttgtttgtactattctcctagctctggttatatttaccatctatttatctaaaaatgttcagggaggggaatagtatgagatcagcaggttggcagatggctatacactatttctaatgtttatacactattctaacgtctagattttccaccacaattatgcatccatgtattatttatataactaaaataatttaacaaatgcacatagtagtatcattctgaattacatttctgggaaattacaaggaaatttaatgtgagctttgaccatgacttaaaaaattattattatttcctgagattatggattatatttttattctttttcattaatttcattcaacaaaaaattgtttgggctaggcgcagtgggtcacacctgtaatcccagtactttgagaggccgaggcaggtggatcatctgaggtcaggagttcgagaccagcctggccaacatggcaaaaccctgtctctactaaaaatacaaaaattagccaggtgtggtggcatgctcctataatcccagctacttgggaggctgaggcaggagaattgcttgaacccaggaggtggaggttgcagtgagctgagatggcgccacttcactccagcctgggcaacagagtgagacttcatctaaaaaaaaattgtttaacatttgctatgtacaatatgatatgttaggcatcatgggtactaaaataggtaatatatggatcctgcccttgagtagcttatagttcattatgaaaaacagacataaagaatataagtaaaataaaattccacagccactaggatagaaacctaaataaaatacagttattaaataatctaaatagcttattaagtacatgatattgttggaatgagacacagtggagtgccagataccagatgccaagttgaatacatgaccaattcctcttagaaaaatcgtcttattgctttgaacaagtagatagcgtggtctccagctacctggtagttaagtgttgaggtttgattgtaacactcaaatacgttatttccatttattattacaaaaactcttctctctacccctgggttatgatagttccagattaaatatctgcattacagaacgttctcaatattcccagtagttgtattctataaaattgctgtaaatgctgaattagcaaatactaaatcattgctcctagtggaaatactgagttaggctcctgcaaacctttggttatattttatcaatctatcaacacataatcttgtttcatgtgtgtttctgtttaaaggcaactttgttagtatatacatcttacaaataattaatttcatggtctttgaatgatttaaagccaagagctttggaggctatttgtattatacaggtatgtttgccaacatacttgtaaagcaagccaactcagtttcatcagtgttgaaaatgtgctcttccacataactcctttcctgtataacacttagcaggtactttaaaaattttcctgtacagaacttgccttgcctgcatgtttagcatttttcatgccttatcacctattgaaaatgcagagcagttagcactagctaaaaaaggtttgaccttttctaaccctgggaaatgtgactgtaaatttctttggctttcagcttcaaaataactctgtctacttcactttgttgttgttgtttgttgtcatctcatgaatccacaaatttagccccttcacactgattttatacctttataagtactatagatgctaacttagcattttccaaggcagccttacataaaaattggcaaatttctgcttcctttttctggatctaccgtattgtttgttcattaatactgaactcacggccaacagcagtaggactcaagcctaaatgaattttaggtaacatacataatctctgtgtaaggcacgtcacagcctcttgcacttaggaacactaagcactgcagcactaagcgtgggcgccattttaaacagtaaaatcaccaagataaagcacaaaaatgtaaacaatgtggcatgaaatgcaccacaaaaaggacatttgttcacagtatgggctgaaacaataaggcagagcattgccttgttcagcctcagccaggaatgtgcttaacaggcaactcaaactttttgctactctgtgtatacctgtgaatgactatgagagtgctgtgagtatccattttgggattacaaatagattttttaagtaagtgaattcacaaatacagaagctccaaggggtgaggatcactgtacgtaatttagaaaccctgcctcttttagccacctcctgtccccccagttgcagtactaattcccagggctctgaactatgaactaaatacaagatcacaaaagattggtttaagggggagttctacaaggtcatcttacgtggtaactattcctttgtcaagaatgcacttatactttttctaccagaggctttaatgttccacgtagattgatgataagaatacagatgtgatgctcttcacaatagcttacctatgagtagtcaaataatgccattcttatataaacaaacatgttataatctggctaaaattaaacaggttatctacttttttgttcatatttaaaaatagaatctatgaagaattatatctggttagttgttgcttcatctttgttgatctttggataaatgatgcctataattaggtgacaaatgtatctctgagtgaggcaccaaccacattaaaaaaaagagtaagcatttttgcatctcactcattagtagtcattgctgggaactccttttctgatgggaaagttgttccatgtcctttaatctactgtggaaatgttgacatcattgcatgcttccctggaattgccacccattctccttcctccccaaactctaccaagttattagttctctaggtgtctttgctgtggttctttcaattttatagacatcttgttgggatatggggttattattgactgaagatggttgaactcatgacatttaaccaagggagaagagatctgtaaaaggatttgactcagagtttgagctacaatgaagcctatgtcttattctgggaatcccttggatgtcatggtataaaatttggttgtggaaaaaaaatgagacatggtacaaaaggctggacaaggctcagatggagagggaggaagtttcccactaactataactagcagttagtaggaaagcctatagaatgtcaaaaaaacaaacaaaaaaaaccaacaaaaaaacaccaaaaaacaaaaaacaaaaaaacagcaaggaggcttttggacacacggtagaataagcaaatgtgaacagactaaaaaccaccttaaaatattagattaaatataatgattgattttaaagcatagataaaattaaaagacaggaaaatccccaggtgttataagaaaataaacataaagaagtagataagctgtttaatgttagtgaggttatagcatgtttgtttatatgagaataaaattattagactactgaatccccaagtgttataagaagtagtaagaagggaatcaaaatgagaggtcatggaaaactaataccaaggcatttcacatgggtttcagaaaggacatatgacctagttactggagaaatggttacaaacacctataaagaagggaagtgtaatctgagagtctttcataaaacacaaaatctctaaggatttccagacctcatagcttggaagacaatcccaaacaattaagccaagaaaatgtaaacaaacttacgatttatctgggactgtgttggaataaccaaacattctgagaaattaaagctgtagatctgaatcacttgctgatgtaggctctacatttataccacctgggtgggataggtaacatgatctgaaaaatcaaccttacaacccagtcccacatcactgaaattccccagcaaaaccaagccccaaaccattatttcataactcagaccattttggactccaacaggattttataaaccaaggtgatcatgagcccacactaatagattgcaaacctcacaagaaaatcaccatgagcaagagtcagcagacacagtaccagatgaattaatgccacgaaacttaaaatactagaacaatctgaaaactattataagataattatgtttcaaataaattataaaagtaaaagctgtaattaatacaaacatctcaagtgcattgttgtgttaatctacaatgactgtttgcattgagtgcttgcaaataagaaataaatccaaagctgatttttatgcagaagctaagagagaaagttgaggaagtcagatttgtttgggtatgtgatgaatcttcgggtttgattttatgtcaccagtgtctatccaaaaactataatgaaaatctttttttaaatttttttatttttatttttttattttttaaacatttattttttcaatttttagagatggggtctcactatttttatttatttatttatttattattatactttaagttttagggtacatgtgcacaatgtgcaggttagttacatacgtatacatgtgccatgctggtgtgctgcacccactaactcgtcatctagcattaggtatatctcccaatgctatccgtcccccctccccctaccccacaacagtccccagagtgtgatgttccccttcctgtgtccatgtgatctcattgttcaattcccacctatgagtgagaatatgcggtgtttggttttttgtccttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcagtaaaatcttacttcatcaggaaaataaaacaatggggccaggaaatgaaagaaaattcaaaaaagttctaacaagcaaaagtgaagtgagaaggagaactgtgggtaactactatctgtgtctaatagaaatgttttgaaaatacaagatgtggaaactacttttcttcaggaaaagttcaatagtttacgacctcattacaaggtccgggtgtggtggatcattcctgtaatctcagcactgtgagagtctgagaattgcttaaggccaggagttcaagaccagtctgggtaacataggaagagtcctgtctctacaaaaaaaaatgtgaaaaaatgaaaaatagccaggtgtggtcaggagcctgtagtttcagctataggctgaggtgggaggatcccttgagcccagaaagtcgaggctgcagtgagctatgattgttccactgcactccagtctgggtggcagagctagacctcatctcaaaaacaaagcaatgcagaaaagatctgattacaaggaaacagtaataatgataaaaatgaaatattaccactctagaacatattttcataataaatggtaaataagcattgatttattaaatatggctccattaaacttctaccatttgtcattgtttctcatatatttaaatcattatcacatagcatttgatttggagaaacagaatatctttgtgtatgaggcctgatgaatcgatagtagcagaatctccatggcaggcatattattggagatgatagtctttatgtaaacatcactgtgggtttttttttcactgtaaataggcatgcaaaactacataaaacaaagaaaataaaacgcatggtccagggacattgaggggattagggaatatatacctgacactttgttgaatcttatgaaggaaaagcactatgtggatggctacagctattctggcatttcctcatatgggaaaccgtcatcaatttcttgaaaagagccttgcagcaaacatccgtgggtacagagtaagtatagataaaaatagaattcacactgagtaataatcttagttcagccttttgccaggatgaccatgtgccaagcaggcttttaagcaccacacatatcaactcagttagttctcccagcaattctatgaagtcaacactaatattattctcatcctacagatgagaaaagtgaggcactggctttacttgctcaaggtcacacaggtagttagagggggaagagactggctccaaatccatgtgaacaccatgtgatgatgtcttgaggatgttgtaattaagaaagtggtttgattcttgactcttccacagacttgaggtcaatgagatagattctctcaatcactcgcaatgtattagacacgacctttatgtcaaacattgctaggcactgtgcaagatgcaaaaaaatgaaacagttgaaattagcttctggtagaaattgttcaagcatcagagatgtgcatagtctctaattctctcatgtgcctggaataatatatgtttagttcaattaaattcatttcagttcgacttaatgcaactacattgattaaacatctcatatatgaagtacttggcggtaggtatagaatgataaatagtccagccctagacgtcattgagcacaccctcagtgaaggggacagacacaaataagtaaataactccaagcaaaagcaatatgttataagaaagggagaattaaagtgccatgggaatgcaggctgaaagttgtaaaagtaattgtaagaggagaagaagtgtgtgtgtgtgtgtgtgtgtgtgtgtgtgtcaaagagtcgaggagggaggaagagagaatatttacatttggccttgcatgaggtagaatttgctaagcagaaaaaggggtagaggatagagtggagagaagagagagaagatggaggagcttaatttaggatcaaggctgtgaagacaccatcacccaagctaaatagttaaattgtattatgtttgaaatggagagcactggcaggattgaaaaaggtaacagtatgatcaagaaatatctgaagtagccaactctgatattagttgaaagctaaactgaagaaaaaaagagactagcaaaaagagaattattaagtagagttaccatgctctttaaaatttctgttttaccacccaagcccccttatatgaatttgctgtaatcataggaaaaaagctaccaaagaataaattgatttgaggacactgatccatgctaactccattaagagtcacttaatctagttttggatatttctatacatatactctagatgtgaacatctagataattaagattctggtcctatattggtgaaaacaaaatttctcagtgtgtttgtgtacaaatcctggttccatcactaatgagtatgtgacatttgggaagttacttgaactatgtcttaggcttctcatttgttgacctgggaaagcaacgtaactgtttcataagctgttatgaagattaagctgcttaggacaatgttggcacatggtacccattttataagcatttactaaaattatccctaagcataattctataagatcctctaaatttctttcttaccaacaactttgagaaattggaactatatgtgcttaaataaatcaagacaaaacaatgagagactcagaacagtaactcttacatattagaatacatttgctaaaaatatgtaataactccttacataccaaaaaacctaaaaagctgcaagcacatttgtgaatcgtgttattctctgagtaacatattttggcctatcatttctctttacttacctgaccaatgatcaggtagtatcagaagaaaagaacagtcacaagagtgacattcttggttaagaacctgtgtaacatctacctaaagtatgtttcaccaagaaggtagattttgattacattttacttctaatttggaagacaatgtattaggagaaagaaaaacttatctaaactgagacaaatgaattccatttagttctatgtccttttcaatctataatgtatcatcacagtgccttgggaagtagtcaagtcctacaaattcattccccctagaaaattttcctcatgaaatgtgttcttatatagttaccacttgagatgatccaaagtatatgcatacatttcaaatttttcattctcatggtctttttttgctgtttgattccttaattttgttctcattgtcaaagcccacttctgtgattcttaaccaaataagtaaataggaggcaatggtttctgttatgaattttatggcctttgtttttttaaagaaagttagtgttcagaggtactttctcccatgtctctaacgctgaaggattggaatacaagccaaaattcaaaggcagaaactcagtcagaagctggcactttgcctatgacttgatggacctgttaaataatctttgaggtaaaacagattccaactacatcaaacacagtgaaggagtaagttcagaaaatagtgttcttggtctagtaaaagtccaggagtaccagctctgtccttaaataggttgaatacaatgaaagacaggaactttcactagtcctataagcattttcaatctctcttgttgaacaccactagtggagacaatgaaagaagaaaaatgcaatatacgtgtccaaggatctctcaggttgccttacagacaaatattataattcatggttttgtataagatatttttctgctgttatttttatgttaagtatggctttttggattctaagaaccatataacaaggtgctgcattccagtccagcttgaattttgtctcatggagcttatgaacaagtgacaacataccttcttgcacagaaaatcagtaacctgcagactgcccagagagggtttcccaggctttttcctgtctctattgtttggctactcccaatttcagggataaaggaaaaaattcttgctgtgaagaactgctgtggagattctgcaatgagatatgtgtgaacagatgtttgctttctaccacttccatgactttccaaaggccagatattgatgtttctctgtggggagtgtaattatgctctcatcatattgacatggagagagagaatcaggcttgttgagttttacaaagttacaaagctggtgggtctgcttttctgttaattgtgaaacctgggaagataatttttaaaactttgcatgcctcttggatgccatttcaatgtatttgctttttttgatagctataatgattatagaatttttataataatcaatgtatctgcaaaagagaaaggaaaggtgagatttgtcaaatctacataatatattgaaaggtggtaacagaataaacattgaacaaaatgatttaaaattgcaacatactgtcagcatcctatcagcaaacatatctttctaattataaaaaatcccaaatgacaaaaccatgattgttgatgctgtaattcatttagattctcttttatggctgaaagctctgtaagctacaatatggacataagaaatctatcactactctggaatatctcagaggggaatggatgatgccacttcctatcaccaagttaaaaaaaaaaacaaaacttgtagtgcctttttagttgaagcaaaattgtgatgaaagccagctgttaagtaattttcaaaataaatgactgctaaactagtgaaaacgtctcaacataatttcaagttcgacatcataaagtgaatgtgacattaaataagcttcgtaagccaggcacagtggctcacgtctgtaatcccagcactttgggaggctgaggtgggtggatcttgaggtcaggagcacgagaccagcctgaccaacatggtgaaaccctgcctccactaaaaatacaaaaattagctgggtatggtgtcgggtgcctgtaatcccagctactcaggaggcggaggcaggagaatcacttgaacctgggaggtggaggttgcagtgagccgagatcgtgccactgcactccagcctggaagacagagtgagactccatctcaaaaaaaaaaaaaaaaaagtattgtaggctacatttggagtagcactttgacatacattttgagacatttttgaactaagagtccattcaaaactctttccagtgcatatccttgctctcttgcgtagaccttctaattaaaatggaagccagttacatttcttttctctgagagtctcaaagtccagtggagggtcagcctgacattttactttgctgaaacaagcttgtcaatggtgactatattgaaatgaaaagtaattgtttcattttgggtgaaataatatcatttcaaagcaatatcacaaattactgtctgatcattttgaagcgatatctagcagtaatattttatactgagtggtttagtcacatatgcctttgtaagatattaaacatctaagtgaaaaatcaagaccatggttagaatattttactagcaaattatattcactgaagaagagagtggttcagttatgtaggtgcaattgaaagaggaaagtgaaagtcaaagtgaaaaatctaatttttttctcgctgaaaaattcaacatctgagatgtgtagtaatcatagattttacaatcataaactaatcttacctgtgtatatgatactctgctaaaatatcataggaacaaggcttgcaaatataatattaaagacaaatgtgtcagcttataatgtcaaatattaaacaaataagaggtcattttgacaaggagttgtgttgtgttttgaaggctctgaactaattgatcctagtctttctcttgaaaggacaactaatgtcaaatttactgtaagaaaagttactttccacagtttcaatgaaaacaggaccatcataactcttgccttataacttcatatttctttagaaacatttaataagtgtagttttagcaggttaagtagataagggtaactaggagagtcgataatacatttgttattaatgaggcttctacatgccatcatgtgaatatagatatactggtcttagtatcaaagatttcatgaaagagcaaaaatttatctagcactatatttactatctctatagaggggatgaaggacagataatttttctgttccaaattatacactgttcacaacgttattaaatttttattaagaatgctagataacctaaacagcttttaaaaatacagcacattctcattattcatggattctgtatttgcaaatttgcccactcattaaaatgtatttgtaaacacaaaatcaatgctggtggcacttacggtcgtttgcggtcatgtgcagagtggcaaaaaagtttcatttgcctgatgcatatgtcctagctgggcttgaacgtggtaacagtcttctttcagctcatactataaacaaacgtccttttcatggtgaatttagtgcaacattttctcatttttgtgctatttcttgctgattttactgttttcaatggcctccaagtatagcgttgctatgctgcctagtgtttcttaacatgagaaggctatggaaagccttaaaagaaaatatgtgtgttagataagttgttttcaggcatgacttacagtgttgtttgactttcaaagttagattcaacagcatgttaaataaagtgtctctaaaagaaacacacataagacaagtttacgtattaattggttgatgaaaatgttgtgaccagaggcttatagggatctaactctgtctttcctgcagaaacagtggttcagtatttgctactttggtgttggcagcatctttatagaacaaaactactgtgaataacaagaattgatagtaccacagtttttaccccatattattcacaaacacaagcaaaaagacatcttatgtcatggtaaaatgaactgtaagaacttgcttgtgtgtaaacattcctaattatgatgacaaattaaatttagtgaaatacacaggcccataattgagaaatgtgtaatcactactaggttaacatagaaatactgtataaacagatgactgtagggatatcaagaagatggttggtatatggagaggtttaatgattaaatgttctgtaattaatacctttgtttaatctttttaaggctcatgcaatccaaatacattgtcagcagacttttcaaaaactgctattaaaaacagtctaggcatagtcatacatctgtaatcccagcactttgggaggctgagacaagaggatcacttgaggccaggagtttgagactagcctgggcaacatagtgaaacccccatttctgcaaaaaatttaaaaattagctgggcatggtggcctctgcctatagacccagctaggtgaggggctgagatgggaggatttcctcagcctgggaggtcgaggctacagtgagccatcatccctccactttattccagcctgggtgacagagtgagatcctgtctcaaaaaaaaaaaaaaaaaaaaagtataggattttaagagattaattttcaattactaatttcaaaggcataggtctcaattaaaagaatttgataatccttagcatttgatcacatttgggagcatttttcattttgtgtctgtgaatttcatgcactaggcccgcgttcagtccagccaccagatcaacacattctccaaactcattaactttggagaggctacccagagttcctgaagagttcatctgaaagtaagtaggaaagatattttctctctgacttttcagctcttttcaatatttatgtactgtggttaaactgccttagccattcaagaagcatttgattgtatctttgttgaatttttaaagatgtgagtcttgattgcagatgcctagaaaaatgctagattgctagtaaataagcctggtagtaacagtctctccttggcatttactaaaaacagtgtaaaaaatgagtcaatgattaatttttcccttggctatggaccagaactgaagtttaatagaacacaaatttcataatatgtagcagctgaaaaaactttcagttaaaactggttcaattttatctggctttaaagactgtccctgagagcatctcagattcacctgcatgattccttaaaacggcaactttatgcaagtgactatttagctctgcagactgaaagagttgccatgttgcactgcaaagcaagttaaatgggggaaatgtgtttccagctatgaatctaatcagaaggtaggtattttttaaaacacgtaagttgctgaaagacgttcagaaatacgagtttactaggttagctctactagctaatctaaactcaaaacaacataaagtcaaagtaattctaatgagcatttggtgcatgggtcccagataaatggatttctaagtaaaagtcaaagctacattaagtcttcgttacaccaatccaaacaactttgcctttgagtgtagatgtgggctgccacacaggcaaatgtatacattatatagtctttgttgctaatatgttaaattagatttttatttttactatagcataggatgcgtaacagtgaccttcatttgatttacatttattacaaaataaattgcatcaatattttagaagtggaaaatcatagtgattctccaattccatactaagactgagaaatgtttctagaaagagctgtgagatgacactaaactgactgtgttctgttacattccttcgcatcgtggccagacttttcttctgtctttgagatacttttatttgcctctcactgaatttacatctctctatatttcccactgtacccaagctattttttgcattcttcttacccccaggactacctgaaagccattattgcaggtgctgattaggaaatgttccatggcctctctccaggaccttcattcaatcatctcccatgccccttcactttttctaatccttgctccaataattattcataatctccttgcaattttcacctcttgtctattgacatatcatgctgcctaaaaactatgctcttctcttaatgtgttgccttccattcaccaataaatttattaacatgagaattgttagtatcctacctattgtgctctgacaatctgactcacttatgtgctgttgaattcttctttttctggaaaaataatgttaccaataatgggctgatatcaaagggagaagcatcatagattagtagttaggacatgagctctgaatcagcctttgctttacctgtctcactttttgcagtatctcgagcaagtttctatgcgctgcatttcctcgtctgtaaaatgaagaacataatagtacctacctcatagggtggttctgaggcttaaataaaacaatacttgtaaaacactaacagagcactcagcacataggaagcatgataagtatatgttaaataaaataaatgtaatacttatttcctctattatcctctccattgacctcttagcagcatttaatagtattgattaccactttagaaaactttcatgctcggtgaaattttgcagcctggcaagtggactggtggaaagcacagaagatccagagtgttaggcacatttggtggccagctagtgtttaattgaaatgtctgatttgggggctcagcctaagtagagtgacatgtaaaatgagacttggagctatgagtgtagaacgtggaattttgagaatttagggatcattatgagaataggttctatggaaatgagaaaaatggtagtttaggtggagaagaaatgaattgtggttgaagagatctacggctgtgaagctcttgctttagagtggttttcagccccagactacagctagtgatgaaggcgagaaagagaactgtgggtcaggtgcccttagggcacccctgaaagttagacgcaaggggaaaggaagagcagctactgagttaggtacactttcagtcatttcagagccaatgcttcctggatgatttgaagttatttattttgtcccattgtacctgccttttggccactgaaatttttattatttacaactctcactacaaactaggcaaaagaaataaatattagggtgatctgtcaattttaacaaccattgctatcttagggttggctgttctttattctcataatgtcccagtacgacatgttgtgattacttattccacttttggagacaactagagaaatgaagaagtctgaattaggtcgtccaggggacccacagctgaatcagcatgagaactaacagttcctaactcccacccgaaactttacatcttctaaatcataatagctcctaagggaaaataactgtgaacaggttctagagattgcgattgtcttccaaaatggaactgatatttgggttttttaaaaaaattcaacacaattttattttggtctttacagtgacgtttatatatttacagttcatctgctgctgaaacagcagtagaatagagtctttgaagtgatgggtatgtgtgtattggcagagttgaagataaacaatgccaaaagacctctaaaaagattagactgttaaccacaaatacgcggtttcagttgagaagatttatttgttgctgaccatattagccattgtagttaacattggttctgggaaagtcatactttggtaatgagccagcaggctgtatttgtagaactacagttgaatttataggatggatgcagtgacattgcagattttctcaacatcaaacagttaatgaagttacaaaatgttctgctggctcttttcctttaagcttctttttggcgcttctaagagtttcaactgtcagatgcacggtcttccagcgttctatccatctgtttccctgtcttggttcatgcgctaaaatgtggtgctcataaaacatggtccttatggacatgattatgtttgtctgagaactcttcaagcggccacttgagataaaagataatggaactagggatagaagtgggtgtaatggaattggagtggtgtcatgaggtaattggcaggtacaaatggccaatcacgtggctgggtactgatctgagcccctagtccatttcaagccctactggatgtattgcaattcagtcctggaactaaccatctggagttggtggtacaggctctataggttaaaggtatggtctccgacaaggctgctcttacttcagacaccagcagcactgaggtggggggtctccagaccacctgcactcctgaaagactgactatacgttttggggttttcatgagcgcttcagttcaataatttgctagaatggcttacaaaactcaggaaagtactataattagaattatagtttcattacaaagaatacaagtcaggagtgctagctaaatatgggacacacagaatgaggtctgaaatggaatgcaaattttctgtctccagccccactccactcccctggagtcaggtggctgaaagccccaaacttctaattgtgtggttagtctttcaaggtgactgtccccattctaaagttatctagaggcctaccacgagtcccctcattaggataatgtggatgatcactcattaggataatcaccgtgaacattctgagaatttttggaactctgtcccgtgaatctggaacaaagaccatacagattctttatgataccacagccctctcctgcactctcttatttaaggtttacagaaattctgtgaaataggtatttttcatccctactttttaacatgagaaaactaaagatcagaaatgtaacatttatatgccccaggtcacacagcaagaacacagcagaacaaagattagatcccagcttggtcttcttcaatggtcatgcttttccagataccttaaagaaaaccaaatggacagtgattctacactgacagataagcatgcttataattgcttgtttgatatctgttttttccctggtagtttgtaagatgtgaaagaaaaaatatgtgttgccttttctgacagccactcccccaaccccagcacctagtatatattattttctattagctgttaaataaatacttaccatatgaacaagtgaacctgaataaagcagtactcattggtcctggagtggatgaaatagactagggactggccagctagaaggatcagggactcccaaatatgtagcatttttagttggtactgaatgtgtgaatgagatgggtagctatggcatccaggctaggtgaagtcagttataggcatggatgtggaggactctgtgggagggaaagagtgagtggttcagggcactggaggtcatgcagagatttgatgctatgaaaagcaagttgcacctgtgagagtgtcattaggttaataacaccctcctcttctgtctgcctccctcacaatcatgaggcttggaaaagtgagggatggaagttattatctaggagcttgttcactgctgccaaaaatagttagctttattatgagctcttgtactggcttcagacagagcctttgggcatcatgggagttactgctgcttcccttgggaactactgtcactgccatgggcatctgcatctgagaagcattccttctctgtgacaattatcatagtaacttttgcccagcaagttggcttttctggatgtgttaatgatggtaataatgataattgctaagattatgaatgtcttgcatgaattatttcatttaatcctcacaataaccgaatgaggcagaaacaattttgtgtcttttttacaaatggggaactgagatttggggaagttaaatcatttgccaaagtcatttgttcaatgatgagtagtctcaaaattttaacccaaatctaatcaacatattgtaagattgttacagtaagaatgttattagaacatcctgagaaagagctgatatacatattaaagagtccttcattttcgtgatgcctactccttgcttgggtgcaaggttatttctgcttgttgattctgtccctttgaaaatcagattttaacctctagcctgctagttcctttgtggggaaaaatgattattgctgttttccaaaataccaaaaaatgtcagcccaaccgcctgagtttaatcagatgtttaatctgatatagcatctgcataatgacaccacaaagaataaacaagaagatcgggactgtgtcataaatattgattcttctatagtcagggcctgctgactttcatataaaactttttatttaattaaatctattgcaaacaatgcagcaaaaccttattctagttttatctttcagaatgttgaaatagtcacagcccatggaatcaatgttttgggtaagattttttttaatggaattctgtctctattgctttaatttctttaatctttcactgcatgaaaaatactctaatatcttaaaatttcatgtatttccagcctaaaaataacatctattatagattttcctcattttattgtgtaaatgtagataagcataaagaagaaaataaaaattgtccagaaagaaccacaatt

SEQ ID NO: 320 - DNA, 89302 bp, Homo sapiens
gctttacactcgcgagcggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggtaagcgggcgtccgggccgatcagggggccggtccgaggccagggccgggctgcgcggggcaggcgcgaccgagagtggttgggagaagagtgctgagaggtcttcggagctcgaggctcggtttggagggctgtgagggggagagcatgtgcccggtttgggggcgcggatcagcagctttgcagtggagacttctgcggctcggaggagtcggggatttgcgcgcacggcgaggccaggaggccgagggagatggcctggaggtcggaggtgcttccgcggtgcctttgaaaatctcccagccgccccgcagcagattaccgtggccaccggcgcttggaaatgtttgtgggtgcatgtcctcgactttctctggtctctcattttggggcagcatccacgtctctatttttctctggattcgcggagtccttccaaatgcgctcctgtgcccgcgccgcggcccaagtgggcaaaggggggcgggaggcggagagcggctcagggacacgatcctaccgaggagccaggacccttcagagcgccccgctgccgggctccagaccccaccgaaggttggagaacccacttcctcgtgccgcaccttgactctggggagagtaggtagtgagtgacctggattgccctgcgggggcagatggttcggtgtgtaggaagcggacggcaacactggatgtccctggcaggtccgggtgtctgtctccgaagaggacagagaagggcagccacgatctgcccgcctgccctcgcgagcctctcggcactgggtgagaggcaactctggccatttcttgctgccctctcgccctctcccggccgctcccagtccagccgggcccggcgctacccgagcgagggttcgagccctctgcgcggccgcgcagaagcaggcagggcctcaacttctgcaaatgtgtgcggctcgccgcctgtcccctttctcctcctgtctccacccgtgcggccccagtggcctggagcttccagccccgcgcttggccgcggcttggcgaggctatgctgcgggaagctggaatccaacgcgcggccggctgaaccgcctgagccgcgggaaaccagcggcggagcggcggtatagaggtgcgaggatgaggaggaccgactcgctaagggagggaggtgactggccgggagggctcactgccgaggttgatttgctcttgttccaacttccactacgggactggagccagaaaccgtgtatcctccggtcgaaagcagcggttcccacctcggggcaccgataaggatttgataaacgggagcgaatcgcgcctgtcctggctcggcgcccgggcccttcactgcgggatcgctaggggaggggattgggccctgctcccctttcctggccgtagtcccccctttctcgtcaccgtcgcgccctcagacccaagacaagtgagggagccctgagactgcagccggcacattcccagggccctcggagcagtcctggggttccatgtcttttgaaggcagcagagcaaggaaaagactcttaagattccagtgcgttttgtaaaaaccaatcataatgctaataatgactgaaccatcgaaaagcaaagttatagacagcgcctgcagacgctttcgggtccggagccggggagggaacttgtgtattttacaactgcgatgcctatcgggaatgtggcaatcgccgaggtggggcctgacagtaatcttgacaaatgtgtgaagtgtcagctcctcctgcgctccttagcgccgggttttgtgcagttttgtaccgtatataccgagaaacttgggagcaggggaaaaatgatttcgacacacccagctacagtacctggttcgttagcggactgttggaaagagagaagaagcgggaatgggagcgggaagaacgttgcgtaattagactcccaattattggcgagagcggccgctttaagaaccactgtggggactgcctgcgaaacgccttggaggccgctgtgtgagctgcggctccgggctggtggccacgcgagggtgtccgccctcttcgacctgcctggatttttgtgctgcagaatggcagggcaaacagcgtgtccttcaccatctagagccccttaaggggttgtccaattcctattgggctaatcagtttgagactcatttacttttcgtgcctgggtctgtttgctggctgcaggcttctttagggaccaagatgtaattaaaatatgtgaaccaatacattgaaagttggtgttgtcatgtaagtgactgctgtagcttttctgagtgcctcacaagggcgatgtgacagtgagggggctctctgctgatgattctgcccactagttcttacattttgtgtttctttggtttagcagagcagtttcttcccccaaatgcaatatgggcagaacatttggaatattcgttctaacaatggcccgtcaagaagtgggcagatgattttgtcccagaatgttcacacgtcgataaatatgttaatgtttaataataaagagtttgctttctaaatgttagttggctgggtgtccttgatagtaccagttttggtggtagtgggcatttgcggtgacatcacagatgtcagaaactgaagcctggtgggtgggggtactgcactttcactcacctttttgtgcacgcatctatcaggaatgcctgagtcctttcactgggaaaaaaatgtggaaattctgggattcacggggtttgaggagtggttcaggcaaatgtaaatgagatccttggataatcagggatcaaagtccagtcccaaagccagacctaggtccagacaccttcccagagtgcttatacagtagtgctcagtacagggctagcgtggaaggggaattggagacacctggatctccaatctccccctccttctgacagctggacttagttgttcctcttctaaaatcaaatcaaactccatcattattccaactctgaagggaaaaaatattgctggacagtttctctcaatttaaacatatattttaaataaatattccctccacacttgatatgtttccattgtattaccagcagcgcaggatgatacagaattgatgtaacacattgttggcttgagtatttaagttttaattcatacagttttcatgaagttcaaaagaatgccatcatttcaagtttttttcagtggtgcttatagggagcctagaattattttataagagaccatggaaatcatctagtcagacttttctctttctggataaggaaactgatgccgagagaggttaaaagacttctccggtcacaaggaaaattagtgctgataagagtcagggctggtcgcggtggctcatgcctgtaatcccagcactttgggaggctgaggctgcggatcacctgaggtcaggagttcaagaccagcctggtcaacatggtgaaaccccgtctctattaaaaacacaaaaaaattagccgggcgtggtggtgggtgcctgtaatcccagctattctggaggctgaggcaggagaattgcttgaacccgggaggtagaggctgcagtgagcggagatagcgctgctgcactccagcctgggcaagagtgaaattccgtctcaaagaaaaaaaaaaaaaaaaaagtcagaaccctggtttattactttcaattaagtatgtattttcctattgttcacaggagagtaccccagccctgaaatatctctagatagtgaggatgatttccgaaggagtgccttccccatcacaactctcaaaccgctgaaccttatagaaaggagatttgcttttctggataattatcaacacctttaggctgcagtagaagtgatgattctgtttgctttttgaaaaaaaaaaaaaaaggaagcagagttgaattgatgctgttcccagtgtctgtaaactttgagaagtatgaattcattgttttagttagaaaaaaatctacttatataggtagacctcattaaacaaaaccaatgcaaggaccgctcctcagtggagcagattgctttttgaggtagagaacattcaagcagctgctagattgatttttgtactgggttagttggcattttcactaggagtgaaaactgtgagactaaacagtttaatttacttagaatgtccctctttctctctgtgtgtgtgtgtgtgtgtgtgtgtgtgtgtgcccgtgcgtcgggggggggggcagtggtgattctcaactttctaggaatttattaagtaaagtgtttagaaatggaaggaaacaattagataattctcagtgctccaggattttaggctcctacatttgaaaatacttgctgtcattaattgtcttgagatttaggcttttccacttttcaggaaatctagtagttttttgggggttttgttttgttttccttggttctgccctatgccaacctgctagtttccctttttattttagcctgatgaatcttcccttttgctttcagtactaaccattgctggtagttcttaacaggtctagcttttaccaatattgtcaagttagcaatattagctcctggggccctagtactctgtacttccacccctctccccaccagtaccatgctgcctgttcacatgatggacaccagctctgatattcaccctaagatataatccataagatgacaaacttgtattcaacaccgactcctactctggctaaaatgctgaagagaatactaagaaataggggatatggtcctggtcatcaagttgcttagtctgattaggaaaaaaaaaaaaaaaaaaaaaaaagagatacaaggaagcttaagtaaaaatataaggggttgggcgtggtaactcatgcctgtaatcccagcactttgagaggccgaggcaggcagatcacgaggtcaggagtttgagaccagcctggccaatatggtgaaaccccatctctactaaaaatacaaaaaattagccaggcgtggtggcgtatgcctgtagtcccagctactcaagaggctgaggcaggagaatcgcttgaacccgggaggcggaggttgcagtgagccgagatcgtgccactgcactccagcgtgggtgacagagcgagacaacgtcaaagaaagaaagaaaagaaagaaaatataaagagctgacagcctacatgcttttctgtagaaatctaatattttgaagcaaaagataagctctgagtagcatttcaggtaataaccgcccccctccccaacacacacataagcacacacaattatttaagagtattatgtgtatttagaggtggagaaatttgttcctagtgtccccggaaccacacagagtaggtgctgaccaccagcttaaagactggctcagaaggaaggtcaaatgggagaaggcagtctttgagggctaacgagaggaaagaaaacacacaaggctccctatggtgtatcccttatcatgtacttcgacaccatacacaggaaggcccctgaaatggaatgtttgctgttctttatacacttgctttgggtggggacatggaaagggagctggtggggctccacagacaacaggggtagtaatttctgttcccctgagaatatcagtggagacagctatgactccaggaaggccaagaagggagagggagcttcttaaccaggctttgtgaatgggtttcagaggctggcgtgtaaatctctgaaaatgtgtgcaagacattatgtatagaagcaacttgttctaaaggaagtctgttcagctctccatagcctttcaaaggttctaggatatggaaaaggcaagcccttgctcttggatgtctgatttggtgactgtcttatgtttcagagtcttcctgttcagatcccagacagttcttgtgttttactgccattgcctctccctgtggtgaagaatggggaggaggaaggtgtgtgtatttagtaaaggttctgaggtgccgcttaatcttccctgtccctggctggcgtgtccgtccacctacatgtctgccctcagtcttggaaggacgggaagccaagtgccctgcacagggtaaatactggtatgattcattttattaatgcttctgaaaaatgactgtgaaaacaaatttatcctcaaatgttccatcatcctcaaacagttatttggatgaccttcatgttctaggaatgtatgtggtcttaatagaaattatattttgcatcaggacaacacaaaaaactgacagtcttatttgtgccagtgccgtcctcagaactttacatggattaactttttaatcctgtgagataagccctgttattatccccacttcattgatgggaaagctgaagtctagaagggctaactgcccaaggtcgtataggtagcatgggcagagctgcattcaacctgagtaaaggaggtccccagagtctatactctcaatgggtgttccatacgcccttcccttactgaagatatctataaagtatttaatactgcttctgactcacaataagtgctctataaatgacaactgcctttgttgttttccttgtaattataattacttttcttttttgtgatttatcacttgcatcaaacctcacaagcagatagggattgaagatctgaaaggccaacatggaactccttgaatttcttatttttcatgggttttcctagaccctgacaagaggtggttctctcctgccccaagaaattcaaagctttccacatcccacccttcgctggtggcaagacttcaataattacttcagccttcggactccattgtgcaggagaacctgttagaagctcttcctctgtggcttctgaagaaccatcaagatgcacaggacttcctgtggctcttttgatcttttgaaattgcaagcacaggaaggaaagaatggatagggggataaagaatagctatgattgttgtgataatagcatgttgcatttctatagagccctttcgctgatgagccctgagccttaacagccatcacactgttggcccctgcactgtgaacctagagggtaccttgagtttttctagtgctgccaaacagaattgcattgacacataccttaatcaagagagaagcaagccgtgttggcaactgtgcatcacagtcgatgtggtggtcatccatgggatgcccctaatagcatctgtaattttcaagtagatgttgggtgtaatttggtgacccttgtctgttcccactgttggaagccccataactgatctgatgaaagcataaagtgaagaagagtggcgagaccctttgtgagatacctggagctgaagagtcaggtgtggaatggacaagaatgttatccacttctaagtgaccttgttttttctaatttcttaagaaatacctgtttgcttgactgccttaggctgtttgcaggggccacttgtacgtcagcaaaactcttactagatgacatcactgccagaagttccacatgtttccaggaggcacatttcccactgcccccactcccccgaacttggaaagattcctcagttttaaagttataagtaatttccatgccagataatgatcctgtgaacagatccttttctcatgtggaaaaatatttcagaaagggtgtcttgtcaatgagaaaaatgaccccattgaaacatatgtttatttgccatgtactcatctgacgttttgtgaattctataaagccatggaagtggattgttagaagtgtctcatacacccctagtgacttcttgaactatccccccatccccagccatggaactctcctattaaaaaaactaagagataagtggtagcaatcttaacaaattagtgattttatctggttaggccgtgtaatcaaacacgtgggcaggaaagtggatccattatgttgtactcatgattgtggtgctgaaggtaacccccattgccctgtaggctgcccccagaagcagggggtacagccaatagtattcttagaagttaatcaattctgtaacgggttgagtgttttggtctcatttttagtccgaggtgccctgatgctggcctgtgactaaggggagtcagtggcttgttatgaataagaggacacatgagctgaatctgagaaagttcagaagcattttataagttgtttaaaatacatccattaaagtatatgattattttttggtaatcatttaaatcattgtgctgtgtgtctacccagacagtatttatctgtctctcgatgttgtattagtatagtattaaaaaaatacacacatttcacttttgataaaaactttgcatactgtcactactttgtataagttttttcctgactgcctctggttagggggcagggagcaagaagaccagcatgctttccttcctttatatttgggaaatggaggtgctgagagaaacaagccacactgtctgaagtaaaacctagaagtggacctggttgtccatggtgagggaaagcccatatgtaccaccttgggctccagttacaaggtaatgagccatgagcacaaaagggtgactcaaaattcaatgccagccattctcattactaatgagcaattacagcaaatatttacaggcctccttcctacctttatgacttcctgttactgaagcactttggagtattgagaaagattgtcctggaaaaatacgtcacacacagttgcaggaaagagtgcctttaagcacacataaaaactcggttacttggctttgtttatgaattccacatagaaacaacagaaaattgtgccttttgaggaactgcttgagaatccttccttctgcatttcaagacaagattttaaaaatcacatatatcaaatatatggggaaatgagacacaatgtttttagagagtgtctagaaataataggactgtgcaagttagtacagcaaaattttgggtcaaagcatgggtcatttgacaaactctctttatgaacattacctctgcaatatttttctaaatgaaaacaatcacacttaatagaattaatcaggatgggagctagaagcatataattcactttccacagattggagtaaatcctcataatgcccctttcctgtgtatttagttaaaaaagcactccagtgagattgctttcgcagtaagtttctgtaaaccactgtacccttgtatttctctcctgtgtttccaagagttctcagatgctattttcgaatggcagcgttcactccagagctggctgaggtcaacgaagctaattttggtgccttggtgcccagggtgaagggagagagaagtcctctgcagagccaaaaggactctctggggcctgggtttggagcagtgtggtgttgctggacacaccacatttcacctttagaacctttatttgtgtgcttgcacaacaaatgtttacccagatattaagataaggaaagtatgaaggtcacatttcactggtgacaagagagcttctataaatgtaaccatatcgttgtgcagcgggagtctgtcttttattctgtacccgggacttagggggaattattggtgggtggggcatgggagttgaggctcttcttggttttctggctttcttgctatcactctgtttgtcttgcctcagctgatgtgcgcctcccatttggtaagggcctttgtcatggccaagacatctaaagaaatcctagtctgtgtggctgggcactgtgtggtcccctgactctctggagtcttccagagttccatggaaattagtgcccccgtgcatttccctgccgactgactggaaggcaccctggctgctgagatcgctttcctggtcccccagaagaggtccacatggtgctgatcctgcagctgttttaggcctcctcagcgggattgtcctatcctcggagcacagagaatcttcagagtgggataggggtttcttttgtggatttgggtttctcttagggatctccaaagattagctagacactcagggcctcagtaaagacatgggtccttggtctagttttcttcccaagggcagccaccatggcagtgggagttcaccttgctgactgcaagggaccccacctcacctctatcgcccattcaccatcattcactgtgcctcctgagttcctaatacacaagcctcctcccacagcctcaaaggcagtgctgcagtactcattcccacttctattccctcacactagctcctccatctggatgcttttcccctctcttcctattcaaatagctcctacttttctattgtgagcccaggcttcccgaaatcttacacaaaatcactaagggagcgtagaaatttccacagtggcactcccactccctgcattactagcttttggttgtttgccaaagagcctgcttatatttccttgttatctaatgacactttatttgtttttgcctttctaacaatatagcatgttcctgaaggccaaggatgtctgattttctgatgtgccctaataccttgcttgcttttttttgggggggggggctctgaaatcatgcttagttttttaaaaaaaataatagaattgctttgttcatgtcccttgggttacttggaaagcctgcctcacaagctctgctttctttattcatgtagatttgacccctttacttatttccctttaaaaagaaagaaaaaggaaaagaaaaaatttgggggaccacagtcaggtcttattgatacataactttatatcagatgcaaacgtcaggctagtattatatcagtgcttcacttcaagaatgccttatacactaatgtgagtacagccaaacagaatactccagcttaatctcaacgttaaaagcaagatggggaagttgtgcaagagggcactagctctcagttcagagatcatcttccctgggaagccttccctgattaactgcacattggttacccctgtgtttatagatggtcttcagtctgtattttgttatttgtatgatgcttttacaacttgcttttgaaggttgggggtggcgtatgtccctgatcaccactcaagtggtaagcccttcaagagcaaagacccagtcattttttcctgttcttttttccccacagaagtcagaatagaggtctcttgaggtgctcagtaattatttgtagactgagtaattctgtctatgtcaggaactttgggagtttggtgtagagaactggaagcacaggtagacactttgctcacatcaacctaacttatcctcattgcttatccaccatgcgtagagcagggtttgtgggaatcatcactgtgtgtagatgtttataggttccctcccaaattcaggtgctatgctgtacggtgaggttacaaagaggcattagatggaccctgcactcaggatgtcctaaaatgatttgtttaagcaatataagatgatttatgttaatggatgtccaagctgcctttacaatgttgccatcttgttaggaagtcacaaccaactcagataaaacattgagcaaacaatggaagattgatagtaattaagtgagagtgagtaagggtaaatagatcttgtgtgttgggaatagttagggaagtgattagtggagattagagggaggtttattggaggagcatgaagacctaggtctgtcttgaagattaggtagaatttggataggcagatgagtatggggcattccatttgaggtgaattgcgtaagtaaaatgagaaggcagcaataaacagagtgtgcaggccaggactggtgagccagttccttccagggctggatctggagctctgttagcagaaaggagatgaggaccaggcctgggctggtgttgggaagtttaggggcaggccttcctgagtcatgttgtgatggaatctttgggttgccttggggccatgggagcagtgcatgcctcttctggcacatgagaagctgctcagggcatctccatcattagccctccaaccagaagcctagctctagtgtgagcatcaagtgggtggttggaggaggccatgatttgtcttctataatattgacctcaaagcctcccctgctagcccttagtaaatcaggcatgtgtgaatgtgcccaaatcactctgatatatgtttctttttggcctgtaccacttctcagggtaataaacgccatgtctgagtctcctagtgcatggagtgggagctggaagaggacagcttgctgtatcctaaaatagcagtgaccctcatccccatgttctctttctgatggtaaagactttgtccccctcattatttgataaggttctctttctgatggtaaagcctttgtccccctcattatttgataaggctctcattctgtccctttctcattctggattctaggtttttgagtctaaccattatggaaagagaacagtcccttcaatatcccactatctgtagggcatgacacagccaaatccaagtcagaccatccctttgatcaatttctaccaataactgttcattgcacaccctgtacaaagcactgcgaccaagctgttccttgaccttctcctttcctagtgtttggtcacaacactccctaaagccctaactcaagttcttgggatgataccaccagaagagggaaaaaaggagccgtcttcctgaagtcacctgggtagagcagctggggatttttccctcctcgagcaggtgtaacctttcccctggaggaatttagaaacacttaaagtcatacctgaacactgtgggccaggccttggccagagatcccaagtcactggagaagattccattccagggaccagtagaggccagcgggtctcatccaagtcactttagctcattctgtccaccggtactttgagggaggctatataactcctgagtacttttggcttagaatttaacctcacaatgacaactgcgtgtttggcctttttttttgagacggagtctcgctctgttgcccaggctggagtgcagtggcacgatcttggctcactgcaagctctgcctcccaggttcacgccattctcctgcctcagcctccccagtagttgggactacaggtgcctgccacgatgcccagctaattttttttgtatttttagtagagacggggtttcaccgtgttaaccaggatggtctcgatctcctgacctgtgatccacccgcctcggcctcccaaagtgctgagattacaggcgtgagccactgcacccagcatatttggcctcttattccttttctgtccctctagtaatcaataaatgcttgtaaaactgggaaactgctgcctggcccaggcaggattggttggttcaatgactcgctccacagtcattctctgctcattgcctactctgtgcaggctgctgagcctcaggcccgagagcagggaagggccctctacagttaggtggaaaggagcctggactgtcagaaccaggaaaagactgcaggtgccagagagctttggagcacagcgcagcccaaactaagggactagtttcaagaatctcctaagaactcccctaggctagaaagtgttgtttacccaaatcttgccatggctagaaatttgagtctagcatctaccttctcacagctccaggtggacctccagaaggaaaaggaagatgtcctaccaagctaacctgtgactagatatctgttagggtgtgaaacctgtgaacatatccacgtcttttcctttgtgttcatttccttttctcttcctttttaaagtaaaacatccttttgaaaagttccaactttgcctttgctgaactcctagcaagtacttttccccaccttggctagtgagatgttgagacatgggcacacctgagggtggtgtggtcactgtggccgccagccagcccaaggccttgggaaagcctggtgagcagaaaacccaggcagaaaggagtctgggtgactgtgagcattgatccctttgttcctgagtcatctcttttgagcacatttgaaaccattttccatacccaaatcaacataatcttggtgattccaggccacctgtatctccttgtatggctccaaatattaccagggcaatgacgacaacttaattcttcttgagttagatcttcagggccaaggcacagtacatgtttattttggagagagacaaactttcacccacttgaatttctttgcctccaaaattagcgttgggatgaccacagggttctgtgtttcttggcttttatcttgccaaacggattgtaaatgctcccgagtcaccttctctttttttgtgtccctggcaaagcctacctccacatggggttcagaggagctctcaagtctctaggagtttgaaagacttttctagatctttctctgatgtgtgtgacctaggacaggtaatttaacctttctttctttaacccctttcctaagtggggttagacatatttgctgctttctcagagtactattatgagtttgaaatgagctagagtttcataaaaccatgcatttttaaagtctattatattttaaaaatcacttttgcaactattatctcaatagaactttgaaaagtttaaagggcagaccttcaaggcatcattattaacaagcacagcaatataatcattaggcacattattgcctgttgatgtgatttggctgcagttggaaggcagccttaggaaaagctaggggactcttgctctcaggcctttaaatttcttacctggctgggattttcagaattattagtttttactaataatgatttttgggtatcagttctatttttgcccataccctgagatgtgaggaaatctgattatacccaagagaccaaggacacttccaggattctagataaagggtctgaccagttatgctcctttctacatctggcctgtttttccctcccctgtggagatggaggtggtttgtgcaagatgtgattctgtcgagaatgggaatatcccttcaactcagcacacccaaatctctaaacctaaagagctacatctgtaccatgtctgctcaggtcctacttgttgctttgcatcttatgagcaagacctaattgtgggctcccaaagaaagcagatgacttgcccaaggtctttaagaggtcagacagctactagcagagaaacagagcgaatgttgacacctaaaagataccttgtccttccggtgttactagaagtgggaaaaaggctttgagtgcaaacgcctggctgtgctacatactgaccatgagatgtgacaggccactcagctctggcctctgatccttcatctgtaacatctttgatgcccctaatgcctaagcttgctcatccctcagccccacccatgaggctggccagttaacttctgccttcaggtctcagcttaaatatcacctccctagggaagcattttctcacctcctttagttaacctccctcctgttctgttttgttttgttttagcagtacttcccacatgttgttatttatttatttatttatttatttatttttgagacagtgtctcactctgtcgccaggctgcagtgcaatggcgggatctcagctcactgcaacctctacctcccaggttcaagcgattctcccacctcggcttcctgagtagcggggattacaggcacgcaccaccatgccaggctaatatttgtatttttagtagagatggggtttcaccatgttggccaggctggtctcaaactctgacctcaggtgatctgcccgccttggcctcccaaagtgctgggattacaggcatgagccacggtgaccagccccacatgtcataatttatttgcttatcatctgtcacctttgctgccccctagtatgtaagcttcatgaaggcagggaccatgcattacatggttactgccatatcctcagggtttggggcagtgcctacacacaggaggtgctccttaaatgtttgttaagtgaaataatctgaggttgtcaggtctttgtcttcaacgttattatttcttatatttgttcagtgcttaattttttttcaaagctcttgatgtagattgaagcttttgtcatttttgtcatatagatgaaacaactgaggcacaaaaatgtgatcacaaaaccagagagtggcagtgcctacctgaacagctcccagacccagactctttccacagacccatgctgtctctcttggcaccttatttttctgtcgtggtgatgttattgtttgtcttatttggcaatgtttacaccggaggagtagaggccattgtgtgttggtggcgtctggaaatacacaagagagtcccaggagaatgccactgtcggttcttaccacaattagcaattgtcaggtcaggggcagtgattgggtcggtgtcactctctacatggctggctctgcgtgttgaaacaccactgcctgtacctccacagatgccaaagggagtgtgggtcctaggactacagccccatttctacccagccctggctatctctccactcagatctaggtcctttctgttcaggaaaacgtcctgtttgtgtagcctgctagacagcaaaggcaagtgccaatcagctggatgatctctctgggcctcagtttccccatcttcacaatggactagtaagtgggaaccagtcaaaattggctcagagatccccaatagggttctagctccattgtgaaataaatttcaagtggagcctcgtcctgactcctgttttcacatgctcccttagagggaaggaaggtggacgattaaagatgattggtcgggagctggaggaaggaactccccattctccaagaggaggttctgttggaatagaggggcagagacttggaagtcgctgttgggcatggcccaacccacttccatgacagcagcaagaccaccaccctcaagaaggaggtgggctggggtacgagaaggtgggctgcccagtggtttctacaaaaagggatagttgtgcttgcaggaggggtagtgtctccatctcctgatgccagggagaaggaggcaggctgctggggtgacggagagcaccctcaactaggtcacactgcactccctctgtgcctcagtttccacttctgttagatggctgatatgatctctgccctgccagttggattggggcttccaaaatatcaactactgcaaaagaagaggttgtggccactgtgactcatatacatgtacatgaacgtatctgaagttttcagggctgatactgatgtgaggcaacccatgcaggcaacccggaggaactgtgtccctcactctgagacagtgagaacggactgagccggaaagctgatggccgtgagaggagcaggtttgaaaatcactgaatgaagtcatgttgtacagagggggcgggggtgcatactgtgggacggaggtgagtcacagtgcataagtgttggggagtcaccttgaacttgggccagaagagtagaaatattgagacttgggtttatctgcctcacatcaggtacatcaagttctggatggctgcccactggccagagacatgaggtggacggctcccttttgctgccctgggaaggccttctgctggcttcggccccactgagcaaagtctgcttgttcactggagttcacacagactccttgccaggcctgcccagaatcctgtctcctctgacttcctgtgctcttgcataatatttccttgctccctgaatggctggccccagtgcaggagcagctcactcacactgctggaccgagggcaggatgtagagggagggcagggatctgcaaacgtcacccaggggtgctctgggctctgagggtggagggcaagaggggcagagccccctcaaattctttggaagattatagcacaaggggagttgggaaggccctgggaccatgtgcacacacatctatctccatgaattgtctctcctgtaaaattatttttaaagttgctaagttgttttcttctgattataaaaaatatacatgttccccataaaaagtcatagtaaaagaaggcatggagataaaaataaaaatcaccaaaattccatcacccagagataaccactgttaactctttggtgaacatacttttctctatatcatgaatattgatatataattacagaatacgggcatacttctaagatattgtaggttcgttccaggccactacagtaaagtgaatatcacaataaaacgagtcacatgatttttttttgtttcctcgtgcatatgaaagttatgtttatattttagcattatgtctaaaaaacaatgtacataccctttttttttttctttttgagacacagtttcactccgttgcacagactggagtgcaatggggcaatcttagctcactgcaacttccgcctcctgggttcaagcaattctggtgcctcagcacccccgagtagctgggatttacagacatgtgctgccacacccagctaatttttgtgtttttagtagagatggggttttgccatgttggccaggctggtctcgaactactggcctcaaatgatctgcctgcctcagcctcccaaagtgttgggattacaggcatgagccaccgcacctggccaacaatgtctataccttaatttaaaaatattttattgctaaaagaaatgctaacaatcatctgagccttcagtgagtcataatcttcttactgggagaggttcttgcctccatatcggtggctgcagaactgattagtgtgacggttgctgaaggttggggtggctgtggcaattccttgaaatcagacaagaatgaagttttttacatcaatagagtcttcttttcaggaaagactctgcagcatgtgatactgtctgatagcattttacccacagtaaaacttccttcataattggtgtcaatcctctcaaaccctgccactgctttatcaacttagttgatgtaatattctaaatcctttgttgtcatttccacagtgttcacaccatctttaccaggagcaaattccatcttgagaagccacttttcttttctcatctgtaagaagctctgactcatctgttcaagttttatcatgaggttgcaacagttcagtcacatcttcaggctccacttctagttttcttgctatttcttccacatctgcagttacttcctccactaaagtcttgaacccctcaaagtcatccgtgaggtttggaattaacttcttccagactcctgttactgctgatattttgacatcctcccacaaattacaaatgctgttaatggtatctagaatggtgaactcttttcaggtggttttcaatttactttgcccagattcatctaggaatcactatctatggcagctatagccttacaaaatttcttgaataagacttggaagtcagaattactccttgatccatgggcttcagaatggatcttgtgttagcaggcatgaaaacaacattaattttgtgcgtctccatcagggctcttgagtaactaggtgcattgacaacgagcacataaacatatgtgctgtcatccaggttttgttgttccactgatagagcaccaataaagtagatttggcataatttttaagaaccctaggacttacagaatggtaaatgataagtggcttcagcttaaactcaccagctgcattagtccctagtaagagagtcagcctgtcctttgaaactagggattgacttctcccctcttgcagtgaaagtcctagatggcatgttcatccagcataaggctctttcatctacactgaaaatctgtttagtgtagccaccttcatcaatgatcttagctagatcttctaaataactggctgccgcttatgtatcagcacttgctctttcaccttgcatttttatgttatggagatgtcttctttccttaaatgtgacgaaccaacctctgctagcttcatacttttcttaatgcagcttccttaccttgctctgccttcctagaattgaagagagttagggccttgctctggattagactttggcttaagggaatattatgcctggtttgatcttctcactaagcttaatcattccttaacttttgatttaaagtgagagatgtgactcttcctttcattcgaacacatagagcccattgtagagttattaaaattggtctaatttcaatattgttgtgtctcagggaataggaaggattggggagggggagagagagatacacacacacacacacaaacacacacacgcacacagaggaacaatcactggaccagtcagaacacacacaacatttattaagatcactgtcttatatgggtgcagtttatgcctaaaaacaattacggtggtaacatcaaagatcactgatcgcagatcattataataatagctataataatgaaagtttgaaatattgcaagaatgaccaaaatgtggcacagatatgaagtgagcacatactattggaaaaatggcatggataaacttgcctgacaaaccttcaatttgtaaaaagtgcaatatctgcaaagtgcaataaagtaaggcataataaaacaaggcatgcctgtgtttcttaaccatttaacacgtgtaaaactgtgctaccatttttattaagttcccatattgtttttgtgttgctgagaaagtttttgagtgttgtaccctaacctcttctttcccgtaagctctgtggtttttagttttgcatagtgtggtgatttttaggagctcatatgccatgttgtagcagaactacttgtaaattcacatgacgtgtcttccctaaattcaacattaattattagttattaatagtattaattgtgaagcacaataaaatgaggtatgcctgcattatcatgttacatgctattgtgaaatgcattttctatatagcaatatatcagaactatctcttgctactaagttacaaagatttaatacatagttgtattaagttccacttatagaggtatcatagtgaaacccttattcattgacatgtccaggctcagaaaacaagctataaccagcccaagcttattttcagacctgaaaagcagcatcttttctatatttctgaccaatgtgttatctgaaaagcggcatcttttctatatttctgaccagtgtgttagctatggtgccccagaaatagctgcaaaataaaaggttaagtgccatgtaggcctttctctaggcttagaataattcacttgattacataggaagaggctgcaatgatgacagcttccagggctgggccagaccttaccctgggtaaaatgatcctccagtgtggcccatatgtatgctttgagccaggagctgctagctgggagaacaagtttttcttcagtggtattcctgtgaccaagatttcaaataagctccatttttaattttaattggttattgtcctcctgaaattttatgacacaatctatatctttaaaaaggcactctttcttctttatacagttgttttcatgatgttaaaaactttaaagaaagtatcattcagatttgctgacagttggaagattattttaaaaatccaactagtttagctgaaaaaggtgctatcagtgtttctgtctcatccttggaaattgtatatttttaaggcttgtgattagctttttctcctccattgctgatcgtggttggaagtgtggcatagatttacagtaaactttgatataatggtgattcctctttgttttggagccaggtgcctgcggtatttgcttattttctttgattcatttttaaattgagttgaatgtttgatttaatcagaagtgatagtatgaggctggggatgattgcttgtggttgggaattgcttgtaaagtttactgtttagtcaagacaaatcgtttcctaaagctctctttttcagatttcttgtctatgtgggaaagcatgataatgccagtcagtttaaacatatttaagagttcccaggcatcttcgaacagaaaaatttgcaacaaaatttggcaacggcagaatgcgaggatttttgcctcattttgtttatagttgtctgctcttcaggcaaatgatctattacaacaatctgaataattacagtctctccttcaatttattcaccctggactcctttttctagaattactggccagactcttattacaccaaattccttgactctattcccgaggaatgaggatgggactaggagtaaaagttaaagagagaaactaattgttgcctgcttttcaaagttttcggtgtgtggaaatttgttgattttgtaattgctcccttagttggtcattacccgattctggtagggtacttgccatgtgtacacatttagggagtgcaaagggacagtaagacttaattggtcctgggaattgttgaacaggactttgttgaaatggctacttctgtacaatgcacatggagcagctgttggcatagcaactcctacgtggaaaagtgcacgccgcttgcagatgacttttgcagtgctcagtgttaatttgataaatggcttttctaatagcagtttgtgggctaatggaaagatcgaagcaaaccttcattaacggaaaggagaatagggattttgaagccactgggtgaacacactggacagccagagctaaatctccattttcagctgtgtctctttttcacagcagatatgcttggagtgtggcagatgaaagtaaattaagaaaactgtctgcccgtgccattatcatcttagattttaagcagggagaggttttggagtcctttctattcaagatacttaactttgtgtgagagtttagtttaagagtactgtagaagctttgcattgtgttgtcgttttcctttgctggtagtggtggggttaaggtggttaaatcgttttttattgtggtaaaatatacataacaaaaaatgtttaccattttaactatttttaagcctgcaattcaatggcattaagtacgttcatattgttgggctacaagcaccactgctcaagaactttttcatcatctcaaatggaaactctgtactcattaaataataactctttattccccacatgctccaatccccgataatcactattctactttctctatgaatatgactattccaagtagattgtatatatagacatataaagtatttgtccttttatgtctggcttatttcacttagcataatgttttcaaggttcatccaagttacaacatgtattcaaagttttatttctttttaaggccgaataatatcctattgtgtgtagacactatattttgtttatctggtcttctgtcaagggacatttgagttgtttccacctttgggtgttgtgaatcatggtgaacatggtgtacaatttgagtccctgctttcagtttttttggatatagacctagaagtggaatttctggatcatatggtaattctgtgtttatttttttcaaaaactgctgtactgtcttccatagcagccataccattgtacattttcacgagcaatgcataagagttccagtttcttcatttccctgctaacacttgttattttctgttttttgttttgttttgtttttgtttttagatatcagccatcctagtgggtgtgaagtggtatctcattgtggctttgatttacattttcctaatgatcagtgatttgtctttataaacatattgcctgttccttgccccccaccccacccccgcacccccacaacagcctgtgtgggaatggaaatcactgccccattgtttacacctgtgaggcaaacaaagactatcaacataatgatatttgggagtgaaaggtgtcagggagagaaggatgaaggcaccataaggttattatatataataactggcatataggatatagtacaggcacctcagtagacctattttcagttcgtgctgtggagcatgtgaaactattttaaatagaggcctttgggacttaagtaacttcaactctctgaatgaggtttaaggcaagcttgctgtgggctggatctatcctgtataatccctactgatttgggtgatgtataggtacccttccctgaaattcttccctgagaataattattgttgtcatctactacggaatcctgggcccactttcttccttcttcttgggggaggaaatctcccagacatcttgccaagcatttgcttaagtctttgaaccgctgcactagctaatttctccacctgaaacaatatacaaacccctcctcttctccacccgctaggttcttatgctggcagctcatatttttacaagaaaaagaagttagaatgtattgagcacctgctataagcctggcactttgctagtcactgtgtggcagatgactacatcagtcatgactgataaaacataacttctatccttgtaagtgccgcaggacttatttgtgactcttaacaacaggggttccaaaccttagtgtgcatcagaactgcctggggcttattaaaactcagattactggacctcatccctagaatttcttactcggcccgcaggtctgaggtggagcctgagagtgtgcatttctaacaagttcctagatgatgatgatgttgctcatccctggaccacactatgagaaccactgctttccatcaagcctgtgaaatagatattattcccatttatagatgaggagctgagatgtagagaggccaaatgacttgcctcagttcttgcacacagagccagagcccagatttgaagctgagaggcctcactccaaagcttctgctgtttccattatatcagggatggcaaaggcatagataccacctgtgcttccctcacttagtccacccccacgacaggcaatattaatcaatcacagcacctctgagcccagagatgtcctcggaatctttcacacactgctcctgacagccaaacctacccgtcagtgggagctgaagtttgcaatttctgtactaacctgtatggcctttctaaaatggagacattaccaaggaatcaatctattaacagctgaaaacaaaccttgtgtgagctccagtcttatctgcctaggagggaagagcgtggtagattgcaggctgtgtgaagcacagcactcccatggcgacctcacggatcataactagagtctacactcagcacacaggcaacacagggccgttacccttgaaaagtgtaaaaatctagacgaagttaatgaggagactttttttttaagctgctatattttgtctaattcatatatgctacattttattctaaaaatagttattctactctttggcactaagtttggtgatggatataaaatagtgatcaataaacagttgttaagaaaggaaaaataaagtaggtgccaaaggcaactgtgtccacacctgatgaggtcttttaacaaatggatgggaggaataaacaagactgaattatgtttttatatatcttgcgcacccaacagttcttagcaaggcccgtgggcagtagatgcccaataaatatttatcatacggaactacaaatcttgcttgtgaaagtacaaagcataggtgtatcctggaggtagggaacagtaaccctgagagcagactggtttaaggccatctctggccaaaccaaaacacattacagaggctctctgagtcccaaagtcatccacagattgatgtcttgcttctcttcttatggcataagagactggtagaaaactgaccaaactcatcaagaaagtaatatttttttttcctctgaaaattgtgaattgtatcagatattgccactattatgcccctaggtcacttgctcatctgttttccacagggaagccaaaacagaattttgcaaagatatacatgagtaatcaaaggaaactgactgtattgggtgtgattctcctgtcttctgaaataacccaccatgatcttttgcgtgtttctgccagcccatacaatgtctggtctcaccaccaacaacaaatatttagtctatggctactgtgtatatagggcaacctcttgtctcatttgctgtttgtgcagcttaaaagcaagggcagggtgaattatggtttttttgtttgtttgtttttgagacggagtctcgttctgtagcccaggctggagtgcggtggtgcgatcttggctcactgcaagctccgccttctgggttcatgccattctccttcctcaccctcctgagtagctgggactacaggcacccgccaccacgcctggctaatttttttgtatttttagtagaaacagagtttcaccacgttagccaggatggtctcgatcttctgaccttgtgatctgcccacctcggcctcccaaggtgctaggattacaggtgtgagccactgcgcccagccctaattatgtttttatatgaattgcacaccccacagttcttagcaaggcccatgggcaatagatgcccaataaatatttatcatccaaaactacaaatcttgcttgtgaaaatacaaagcataggtgcatgctggaggtagggaacagtaaccctgagaacagactggtttaaggccatctctggccaaaccaagacacagttaaagggagcatttatgtccctgtttggctgtgatatgccctatagactggggcaaggctgtggcagcctggccaggatgaaaacgctcatccttgggctgcccctagatgccaaactttttccgtacaagttttcaaggcacattattaaaagcagttacgtaagtggggaactaactgcaccttataaaaggcttaacaggagagacagagtcctccatttggagctgttttgttaaatgttgagaatagagaagtccagaagtggttggtgtttctgctctacactgaaaacgaattgggctggagcccatctcacagcctgcctttctttcttctatctcacccagcttgggcacaggcttttgctatactgttggactgggcagttccccattgatagagatgttgtttaatatttaagtatgttgtgtagctcttaacatcgaaagagaagaaaaaaggtccagtttatctttagggtgagctgacctttccagatggagcagggaaatctcctgaggacaggaccctgggaggaatccacttccctgcttaaaaagcatggtgaggaaggttcccttgggcttgttggatccagtactctccagtgggcagtgctctgtatgttctaggttagagtcttagataatatgggattttaaaaccagtattgtattacattagagtattactgcccttgggaattttttagatagttccttttggggagagaactgttttgtcctatccattgcagatgggagcaagaacatacaaaagagcataaagaaaaattctgccgatgtgggcatttccttgaggctgagggactaggagaggcaccaaagggtgtccttcattcatggtaaaagccctaatagcctcagtgttagaatatcctgtaggcaggcgaaggatgacatgactcactttggtggtgacctcctagtagttcaactgagaatccaggcgggataagatcagtgcagggtaattgtatggtagctagtcaacctttccattgcttagccggagaattctggcttttgtgctggtgatgtcaggcaggtgttggaggaggagttccatgaccattttctctgttcctgccaacaggaaagctccattgggacatacacgctcacttccagggtgttttatattcatccatagctgctgcatggataaaaaatttggcgaaaaacttgaaatcctattaccatgatgatcattagaactcatgttagggctttttgtttttaaaacagggacacaaagaagaaacagaaggctgccatatgcaaggttagtgaaagccccttaccttcaccccatttaaatcctgaagagggaaagtagctaagctgtagtgatcacttcctgcaaagaaaaccataattatggcgcccagttattcttcataaggggaaaccttggaatagcatgggtgctattttgaatatttgagaaaacagtgacattcaatatgaaatggaaatgattctgtgctgctgggattggatcagttccttctaggcatcagttgcccctggggatagcctagttctccctcctgtgtgaatttgggaaacactagaatcttgtagttgttgctgactctcccaccagcagggaaccaacttatgctcttgggagaagcagggggagtggggaatctgcttttctctttaagcttccaatctcaactgcctaataacaagggaattcgactatcaagatttcctggagtggcttaagtatgggcgccaggatgcagtcttctgtacacagtgaaagaaaacgggggtaaaaaccatgatgaataggtgcagagaggagtggctagatcacctgcctgggggatgagcctcccacgtgactgtaaggttgtgcaagaattgggcaacatttggtcagggtggagaggccttgacaaagcatttgtactcccactagattcctatctcctccgtggggaaaaacaagtatttaaagttctacacagtgttttaagaggaagaaatggattgccttactaccctagcatacttcatttgtacatatttggagttctattcactaagcacccactgtaggaagggcactgggctgaagatcccagaaaattaaaggagacacctttgttcctgcccataggaaatatagtctagtgggggccaggaaggggtaagacgagcatacaggtgatcatactcaagacaggagatagtaaataccctgatatggaaatagggaaaatggttctaggggttttggagaggagaagtgagagggaggcggtaagcctgcaggccctggagccagactgcctgggttccagtccgagatttaccacctatgagttgtggtatcttggagaagtcacttaaacacattgtacctctgattcttcaactgcaaaatgtaggtcactgttgtacctatgtcagtagataatggtttactgcccataaacattggtctcagcttcaggaccagcaggggccgtgctgaccttgagctagtgacttacaacctccaggtctcagtttcctcatctgtacaatgaagagattagactggataaatgctaacattttctttattctaaagtgccgtgatttcatggttgaatatgtattaaatgcctgctgtgtgcccaatattgtgttggcataatgaaaaagagaaaaagtaggatatgtggtccctggcctcaaggagctataatctaagtgaggagaggacattaatatacaggagagtattagagaattagagaatattagaaattaaaagctaggtggtatgggcagtgagaacataggaatagagattttagaatggaccagagtagtcaggagatttgatagtgacctatctaatgtttagaaccacagagactttagacaggagctcagacttgtttacaaatcccatgaattctgaagcttggaacactgccattaatatttaaattaaagttgaactgcagaaaaacaaaagttacctatttggaatataaggtgggacaaagtttataaaactccatgtctaaaaccggtagtgtggatggaagctataaagaggctcaaaccagcttcccatatatccttggatgacaattccattagaatatagcccctggcacagagtaggcacacacaaaaattcatctgttgagtgacttgtggaaaaagtgttctgccctgttcagctttgaacagctgtgggcaccctggtggtggtctcagccccacctccagagggcagtgcacagaggaggccccgccagagccctcctgccaagtctttgggaagagcttaatattgcctcatgcctcctgagccagccctctatcaaaggtgaattctctgctcccaaatgttaacctacctccgggggggctacacgtactccctccccagaattgtctgaacttaggttttgagaaaacttggcaacagcctcaaatttttcttccagtctaactatcctatggtccccagagtccatatgcagatcgggctgttagtgaccctggcttacacaggtaaaaaagagacttaacaaaacttggcagagactgctaagtgccaaaagagtggtgtagacagtaagtgaggtcaccccggccaggaaattgggggcacctcctggaaggagggagagctaggagcttgagtgggtcttgaagaatgagtagaggccacgatggcaggtaagacaggtggaggcattaagtacttctgtccccatgaccagttcccccataccactcttcgttaaccaaacatgggaggtggcaggcccatttagatctggtgctttattctaagggaggaaatgagatgaaaatgacagatgaagtgcaagcttgaactccctggcctcaaccagtcactgagaatggctgcccatcccccaaacagtcagtgatggcctggtttgatgggcctgtttatgacctcctggcttgagagcagcagaccacaaaccttcacagagctctctgttgaatttccttcccagtacagaacccagaagtcctagttataaatgtcactacactttatttatgtagcatcctctgtgaaaacatgagtatatatcatatctaccatcagaacgtaccttcagcaatcacttagaacagtggggaggacagatggggtcttcaaggttcagaaaggtgaaatgtacaatatcttcccattgtaactcttcagagcaaatcagaggtgaaaatgttcagaacacaagtctgccttccaggccagtcttctaagcacctttttcttctctttcacattttacccttgtctcattccctgttccctcctcctttttgttcataaaaaaaattatttttttccaaataagcaaaatggagtcaaactttgcatcctcaaaatgtatgaagtaaacattattcctaatgagcctctgggaaagtgctcacctttgaacttggccaaggattatgcagcaaagaaaaagtcttaagaacttgatagagtgttagagcttcctgggtttttaaagtcaagttgcatattacatttcttttccttaataggggcatttccagaaacccttcctggttgagtaggccagtgtctgaaagtgaagcgctaggattggttactgactctggttcagggattgtcatctgggtgcgaggcaaccacagggtaggaggcaccattgctagaatgctctttctttcctaggactcagcacctatgccgacagtccttgcaagacaggaggggaacgtgtaggctatcctatttatggtaaggggaggcctatggaaaaacaggaagatggtcaagggaagctggcagcaaaaaggcaatgagaccgaggagttgtccctgtaagataagctcttttccccttggagaccttgcctattaattggcctgtgctcatctctataggctttctattaaaacacacacacggccaggcgtggtggctcgcgcctgtaatcccagcactttaggaggccgaggcgggtggatcatgaggtcaggagtccgagactagcctggccgagatagtgaaaccccgtctctactaaaaatacacaatttagccaggtgcagtggtgggcacctgtaatcccagctacttgggaggctgaggcgggagaatcgcttgaacccgggaggcggaagttgcagtgagccgagatcacaccactgcactctgggtgacagagcaagactccatctcaaaacaagcaaacagacaaacaaaacacacacacacatccttcttaaagacaaaaacacctctggctgtctgcatagcttctgcctgcctctgtggaatattacacattttaaattccccaactattgcctcacagccaagaagttcacttataggcattgagatgaatcattcacagaatgacttaaatccaactaagaatgtgtaactgctgaacattctgattgaggttccagaccgtttgtgatgccacatgtttgttgtaacaggcagaatcatcagtaatactttgtttctcttttcttgaaactttccctccaagtttccatcttaatgctttaaatcatgacagaatcaaacaagctctgtgccctctgcccctgacccccgtgatggcatgagcttcaccaagcacccccattcccacagagatctgggataaaaggctttacagaatccagaatccagctccgtttctgagctgttatcgcttcatagcacaggctgtctttttctcttcctacacgtagagctaggcacacatagatgggtagtgcactgtccctgaactgaggctctctcaagtccaggctaccttctgcccagcacctacttagtgtagcttatcttttaaaataagccatcctgcaaagagcagggttcccagtggccttgaggtttgtcagaagttctctagaattggcaacttagctgtgacctcagaagtcttggctctggcaaagcaaggtctttgcgctaaaacaggctcagtgcccatggagataatcacctcttgtaatatccacacaatcatctcattgtcaaagcacaaggaatgcaaaaatagaagaaatgccacaatagggttgccccatggttcagctaaaccaggattctgcttccggctgagggcaccttgggacaccttaggagggatggtcccaagcattgttctggagttcagcccctgttggcaagacctgtcctcctacaaccatagcctcacggggcctgattttgccccatctttttgggactcctttaccacctccttgtcctggctaactctcctttgtccttaaattcacaactggggaaacccttgaggagtctttttttttttcctccccattttgggttatgtcatctttcttgctcccagagcacttgctcctgacttctgtagcaatggcctcaacactattgagtgtgtagtatttcttaggcatggttctctgcatacatgtatatattatttattcctcacagaggctctgtaaggcaggcactcatagacgctgaggtttagagaaacttaagtaacttgccccaggtcatagagtaagtgtccaagtcctcaagcccgggcagtcctgctgcatctgcatggcacatgcgcttggcctggtctgctcagtgtgtctccctgactgggctgtcagttcctggagggtagggatctgtcttcccttctctatccccagtgcctggcatgtagtagacactcagtaactgtcaaataaatgaaagccctggctcatcaaacaaagaccagatgtgatttaaattccaaggagccatactttttacaaaaatgctaaaatgccaagaagtactttttcattaaaacaaaacaaaactgttttagctatgtaagggtggccttttagaactctgactgctttagatctttcctctaggtggcatagagttgtggggtttggcagaccaccatgggaaaagaacagatgcatttgtcagaatctctgtggccatcagacgtcactccaatgaagccaaagctccgaggtttaaaaataattaagggaaataactaagcggagagacagaaaagaccacttcttagttgattctggaaaaatgaaccttttctttctaccaaccggcaccgaaattcagagtatcctggacacagctgagagactactcagggagagccactgcagtcacaccccacctccacttaggtctccctacactcactctaatcttctaaatcgtttaatcagacacggcgctgcctctgaggcttcaggactttcaggctgtttttttttccccgggcttaaagtctttctctgctgctgactcacatgttaattattgctttgcataaagtagaattagcagtgctcctgcactcacctgcctgcgtgttatacaactgttttatctgctggacagaactgagtgtgcaggccggcctgccatggtgtcaccagcggccctgtcttcagctgccagggcaatgagcatcgcacagaaaccaaccattgctttagaggctctggggaagaggctgtggggtgtgctctgcttgtcccaggaaaaagagggttaagtgccaagttttgaccaaaatcttataagaatggtccaggagtttcagttccctgtcacctgtcagtgttaatggacagaactggtgtttcacagaaaaaaaaaaaaaaatacgtgtgtgtgtgtgtgtgtgtgtgtgtgtgtgtgtgtgtgtgtatcaacttgttttctctttggctgctgggctggataatgaagtaaagatgacattatctctaataaaagtgatttgcagaaatcactgacgggacctcagtagcagagattcgccattagcaggctagccagataagaggggcagctgggttctgttaaccccctcctcgtctgatgtgtgtcttgcagggaagtcaaaggcggaggagtagagtagagtggactttttgaagtttgggctaatggacagtgttttttccaaagtgtgggctgttctttagccccacttgctgatctttagggatgtcattaggttttcatttttgttttgtttcttaggatttttgtgttagtggctttttccccctggggcttggcccattttctcacctctatgttatatcaccagaagggtggaaccctggccaagccctggcatcctctgccagaaatctgagtccaagcagggcacctacacatgtgaggtgagggctctgggccacgggtgttgggcaacagattgttctgtagtgtcgaggaggtgggatctgaggcagaaacctccctggcctcttaaggatgggacgggtcaggaggggaggggtctgcccttgtccggacttgttcacctgtgtcagtgagagctgactagcagctggctcacgaaacacacccatgatgtggacagcgggcacagccagctacttctgtgtgaaaacatccttagtatacagggatttgtttcctggggacagtgaggagtcatggggtgttaagcaacctagtgatgaatatagccaccatcactcgcctttattaatccactttctactggaagcactaaagcattggaactctgcaatacccccacagctgggggaccgtgactgatttaatcttcatgccagctcaccataccataactgaaagggctgtatgacactattattgttggagtaaggtactttgatacatgagaggtttgacattttgcctgtgccctcagagaaccttaaaactaggactaacaaggtgacggtgccttgcagtcaagtagcacagattgtctaagtgttccaggcaggagtgaggaggagacaccagtgtaggctcggtaagatgctcagaaaagcctctgtggaggtggcaggcctatgttggctctcaaactttagggtttagaaggtcagaaaggaagaagcacttcaggtggaacaaatcaactggggacatggctgggcagcagaaaggggtgcggagtttgggggtggcagggcatagtgtggtctggctggagtaagcgtggagctacaggatcgtaggagctaagtttggaaagggctgggagacctcaaggagcacgtccagcttggacttcatcatgaggatggtggggagcaattttcattttaaaatgggggagcgacaagctgaaaatggttttggggaaagagtggtgggctggcgagctgttccttgccccaagatctgactcaaattttattcttggtcagtggtaaagaaagtgaggggcaagggaaacaaacagaagatggggactaaggtctgtggaaataaataaaacaccaccagagccagaggaggcgtgtgccctgggtgaagtttgtttttcatcccatgggtaacatttatgagttactgttcagcaagaatgccttgcggaggtctctgtggactgagctgaggctccagcctgtggcagcccaggaattgctgccatatttagagcttccaacagagggtttcattttccttggctttggtgccaagaaaagaggggttctcacacttgctgtccagcagggccaaagcatgaccagcaggaggagcatggaggttgggttctggcactgcccaccacctggcacctcagccactaatcagacaacaggctaggcaattatccgggcatctgactttagctacctgtccttttgtttaaagccctttcgtgtgcttggcaccttatggatactcaacaaggtctgtttaatgaatgcgttctccccacccagattctcaatgccttgctccctgttctctagcctgtctcccgaccactggcacctctgcccattcccagtgtgtctttgtcatccctctgccatcctgattgcctccctgtatcctgctcttctttcaaagccaacctccagcagagttctccctgtcttctccagccttgcaggctttctcctcccaaactcctacagccctgactgttcagcccattcttcaggacttggctcttcacctctctgcaagctccctgaggtcaggcatagttgttccacatttcattctactgctcacagccccatcgtaggaagagagaatcattaatatatattgaatgagcagagggaataagccattgctgggggaaaaatacagttttatttcccaaattgctcaatgttatttgagagcatgataataaatttggaaaagacttttagcatttcctgtggcttttgatgacttctttacaaaggaatggaaatgtgcgcagacatctcacttctcatcagagcaagagagggcagaattgggggaaagcaagtgttcgcgctgtggcatgaatcagatcccacaatactagacatgtgaccatgtgaacaggcctcagatcaggattctttataaaggaagcccaggacagattctctaccagctctctcctctttcacttttcctctttctttgctttcctttttttaatagggaggggagaaggggttatgaggatgggggtaggagagtgagggatcccgtgctttctcccccttctcttgctgttttgaaatactttaaattccaggaaccagaagttctggcaacatgttgggattagtaaggcagatcctaggatatttcactattagcatgtgatcaagcatcagtcctgattaaaagtctaaacaaatgttttctttgaaattaaagtgtctgaaataaagaagagagaactgacccttaaaatcatattctgtacttgaaaagagttctgacaactgtctgtcccggttatgtgcacccccgccccccacccgcctttttccatccagaatgtttgacgacactgccaggggaatttctgccccctccttcctgtatatacccagtgctggcctctgaggcagtccagctctgttttctcatgacacagtgattatttttggcattgcagatattttttctaatgttattacccagcccccttcttggttgccttttgtggagcaatcttttgggtaactccctgtaaatttgagggttaattttagttcggtgtggtagaggaggcagtgggagagaggaggaacgacttctactccgaagcgccccacccccaccttaagaggagccggagaggtcctctcacgccctgctcatgaaagagcttgctttcaccagctctgtgctcaccattcatcctttctgccggcgggcttgaggatatggatatccagaggtgacgctgggggctgcacctcggggatggcatcttaatgacttgacttggcgggtgttagaacagccccattcagagtgagttcactccctgcgcagttggctcactcggcctctgtccatagagttctcttgttcacgctgcaggaggaaatggagatttccaagtgggaaggagccttcccgatgctttaactcttcactgaagggaagaggagctgcagagagcgaaataaaatctaagccgccccagctgcagcgcctgggagaggagcaaggctgggctggggatggaggccaaggcagctgggatcactttttctttcctccttgagagggaaaggaaaagagcaaagggcatttttgattgtctttcacaatcagcaaatatttacccagtttgtctgccctagcccaggttccactgaaggatacacgaaagtggaagatgttgtgtctgtgcccttcccctggtacttacagcacagttataggagtagaacgtttgcatagaaaagccaccaagacagggaggcctttaataagggcctatgagtagtgtgggcaggaagtaccctggagaatgttgctaaggggccagggacactgctggaagaagtagggcttgggctggtcctaaggggtgggttttgaagaaataggaaggaataaaatgatacaggtagggaagacttgaaggaggagagggacattaatgtagggcttagtaaaatcccataaagaaagctacaaagagaacaggattcttcctggccagagagaagattggacttgttggactttacgtgcctcagattaggatggcagcaggcagcactaaccctgccagatggcatcttcagtctcaagatcgcacgtgttcctgggtctctttctactcaaagtgtgaggtcacagactagtagaatcagcatcctctgagggttgttaggaaggcagaatcccaggcttcagcccagatcctactgagcctgcactgtaacaagatccctgggtgattcctggccacagcaaaggttgggaagtgctgctctgggtgactccacaggcagctgtcagcagcactagttcagaccccagatttgattcacagaggtgacaaaacaccaacagacacacacaccttgagtgtccgcagggtgactcttcccagatggaaaccgtctattctaattaagagccgggttagaattcttaggaaagatctagaacagtgagcagctttgaggaatccacagaactgaagtcattgacgtggtttttatccgatgtctccagtttgtaccactttgtactactgatgctttagaggacaccaaaagaacaggtgtggggttctttccctgaagagtatgtggtctagttagggagacagaagccacagaagtgaaatcaaggagagcaacacagggccaaatcgtgcgtgtgtaacctctgaaatgggacttggaggagaagtcagtgcaggtgaggctttcctagggaaacggatgcatgggagatcttgaaatatgagcctaattcagacaggcctgggagatggagagagtatattccaggcagggagtgggaggggcagcagcagtagctaagtcccccctagagactgaagtggggcgggaaactgctccccacttgccccacggagtttgcttcatgccgaggaatccgttttacatctcaggccttttcttcttgattcaaccgccgtgcaatttctttgtcaattttcttagctgaaggcagtgttgtaggaacaggatggcagcacaggcagaagggtttgagccaaaccacagatggtgttgttggaagcttgtgagatccaaaggaagaaggctgctgatgggtagaagccctaaggaaaaaaatctaaatcagatctggtaacagcctgggtgtggggaaataccttcaagcccagagaggtggcaccaaagaaaacagtctggtgagaaggaaacaacctgtggcagctgtagactccgcaagcaaagcacaaaccttttttttttctttttcttttaaagacagacttctccaagctgagaactatcccaagggggctggtgtgccagctgaggggctggcctcaggcaaaatggtggccagcgtgtctcactttgctgcttcccagaccaagtgtatgtttcaaaaagctcatcagatttagtatcctagaaggcttcaccctcaagatgcccagctcagctaaatcttttgaacctgagggacttgcttattggccttgtagggaaggtcacccaattacaatcaagaatatgggatttagggtcaaatgatccaggtttgagtgctggctccatcactgggtgatggctgggcatgccactaacatccttggggtctgtctccttatgtgtaaaatgggagtgatacacctgctctgcaagattgattcaggattaaacagaagcaatatgctgagagttctttactaactggaaagagtcacatgtggttgtttcctagttatatagtcagtatctcagcttgcggaggttaattagtctcttagctgaaggctgcatggtgtcaggggtcgggcagtggcagacatcagaggccacagagagcaatggagagccacgcaaatgcctcctgcacccgctggctttctccctgctttttcatgagtgaagacagcaccgagtcttctctatacatccctgcagtggataagatgaggggtgggaaagatggaaagaacactttatttttacagtgggggaagaggtcctgctcatcagcaagggtggccctcttctcagaactggattagagtcaaaggaagccaccagttttagcacagctggtcttctcttcagatgctttgacctgcgtatgcatgaggaagagaagcagcctagagagagctggccatgggaaaaggaggctgagcctggttccaaggctgagactgttgcatgttctgtcttccttccctctgatactgccctctgaagcaccgtgacccatgctttgtgctcagtaatgctggctgtggtcctgaggatgccagtgtagccaaatctgccaactcagctttcatggggtgggggtggggtcactgtgaggtggctacggggagctggcagcaagctggatacatatcttttattgtaagaagtaagcaatacctgatgccaaggtagttgtcatggcattatttataacagctaaaaattagaaaccataacgaaaagcaataagggaatagtaaaatgcattgtggttcagccacatgatgtgatattgctggctattatgaatattttgaaagaattcttaatgggatatcctgttaagtaaaaagagcaaagtattaatttataaatccaatgagatctcagctcgttttcttcatacctttttgtatttttgaagttgcttatactaaatatgcattacccttatcttcaccacggcatttttaaaaaggaaattatgtgttgggaaaagctaggttatatgatggacagataatgaaggtctgtttctaatcgtgccacatggccagtgctgcttgtcagcaggcgctctgttcacagggccttgaaaaagccagaactcggggcttttgttccagttccacatactcccattacctttctaaacctcagtttttccttatctctaaaatgggaatgatggtagctgctcttcctagcctactgtgtgaaatttacaaatttagttacagatttccagattcactcacgagtgttttagactgtagtgtgtgatccaaatgtaaagtggtattattcactaatatgtagaataaagaatgccccactgtcttagcccatttgggcagctacaacaagataccgtaaactgagtggcttataaacaacagagtttcatttctcatggttctggatgctgggaagtccagtgtccaggtgccagcagattcagtgtctggtaagggcccactttctggttcatagctgtgtctccacatggtggaaggggtgagagggttcccctgggcctcctttgcgagtgcactaatcccattcatgaggacttcactgtcatgagttaatcacctcccaacggttccaccttcagataccatcacattgggagtggggatttcaacataagtattttgaggggacgtaaacattcagaccttggcacccactaaggcttgggcttgatgaagctaagcacagggacagttcattatgattattcctgtgtacacacagcttttcccagctgggctggggagtccacgtgtcctccggttacgtaaggagctgggttatctggagccccagatgggctgcttagtaatcgaatctgctgctcttttctacaaggctgcctggggctgagaaggccagaagataagtatctccagtcaacccaagcagaattgaccattagagggccatgctgggtgagccccagacattactgtcagcgctgaatgcagtccaggccctctgctccagggacacagaccgttagagtaggtcagagagctggaggctcagccccagcggagcggaggttgggaggctgaggtatgagatgctttccaggattcctctttcagggaagtggcaagtgaaagcatttgtccctgttttaaccactccagtctcatgtcttctctcttctttgtcccctcttgtagacttttgatatactagtgtggattattagtcttatctcccagatgggctgtggtctctttcaggatagagaccatgcccctcaggagaggtgtgtgtattaaagcatattaatgccttttttctcttgtcaaagtctgtctgatctggccagctcctcctgaatttgctaatttaatattttccattctgaatttgtaactttttgttgttttgctttgagatgggttctcactctgtcacctgagctggagtgcagtggtgcatggctcactgcagcctcgagctcccaggtcaagggatcctcctgcctcagcctcttgagtagctgggaccaccggtgtgtgccaccgtgcccagctaatttctaacttttttagagatggggtcttgctgtgttgcccagctggtctcaaactcctgggctcaagcaatcctcctgcctcagtctcccaaagtgctgtgattataggcatgagtcactgtgcctggcctattttctgttttcactatctaacattgatacctttcctccctttgtgatagattcccctactgatccctgcagcctttggacatcagaatgtacctagaacactgaccactggaacactgccttcatctcaaacatttttgtcactcctttggaatggccctcacagccaagaccattcttttcaataccttcaattgtggcaaagtcttatcttttgagggcacattttatcctatcaaacaaccacaatccatccacagctaagtctggtgactaacggggtgggtaaactggataatattgtttggggtttgaaatgaggtgtgtcctttgaagagttgtgactgattttcttatgtggctctgaagttaattctaaaagacttcccaaaagacagagcgatggccacctaccagcataaagttataggcttctcccaaggtggcttctttgaagggtagccaccttctgtgtggcatctatttcacatgtctcattattttcatctccctcttcctattagccatagcatctggtacagtggtgatcacaccaactcctagataaatgactgtttggcttatgatggtgacttcaaatttgctggacacagtgaatatggacacagtgcatggtagagggaaagagtgtggttaggttttggaagtggacctgggcgtcagtcttccatagacacatgatcacaggcctggaaatctatgttttcataagtcctccaggtgattctgatgcaagctaaaattgagacccacggctctgcaaaactggggccaataacactgcatcatttaagtgaggatcaaatgagaccatttattaaatgcatctggccccagtgctcaataaatatgtttccttttcatcctactctttgagaaaggtgacatagctgtttgcatctccaaaaacatttaagtccaaccccatctgcctccccccaccacacacacacccacccatccatccttcctttaaaaactggctgctttggaaccgtggtcctcagccctggctacacgtggggagcttttaaaactcccattgcccagcctgcacctgagacctattaaatctgaatctctggggatagagcccaggcatctgttttttaaggttcctctggtgactccagtgagcagcaaaactgagaaccaccgactttggttctgccccagttaagtatggggaccagtgactctttctcatctctggaacctggagctgggtgtgtttctcctatcaggcagcccctgtacagcagccacaagcctcatagaagtgtcactagacctctcccaattgcatttgacctttatttcctccattctcagcttcttgcaaattggctccagcttggaatttcaccaccaaccaatagactgatcccagctggcttaattagcctcagtcatctctttacctgctgaaatccattctgtttctaagccatttaaccttatagggtaataggcatattgttttgatacctgaatggccacaggcattaggcatgtgagtcctaatcactctaaaagtctagctaattaggcagccaacccctctgtgttactggtgacagacatcttggggcctcactccaggctgtgttcatatggaagtcaggaaccaagatcatcttgaccaagagcagatcatccttagattcatgacctaagtagcgatccctaagccatgctcggagcaatgacctaaaagttaagatgtttttaagataacgaagctctgggcaaagaggtttttcctggatgaactgtagcatatctctgctgacaatttttggacatttcagttttgttttatcttttgactggctgcctggtgcttaagtggttgttaactttagctgggatcaaacgtttcagaatgtgagtttccacctcggggagagtaactataaatttgtgcatatgaaaatgtccagggggaaaaaaaacaaacccaaaacaaacccaaaacaaaaagaaacacctttttctccacctgcggcatagatagatactgtggcagggttggacctgctgcttttatggaacactgcagagccacatctgataacattcccccaccctcccagcactactgtgaccggcacctgtgtctgctaaggcccacagcacttagtcccttcttcccccgccgaccccatctgaactctgatgctggttcttagtcctactcttaacattccaggtgttctcctaaggtgaatgggtgcacacttaaagacatgaggctcccctcatgaaatttttgtcactgtatttaaaaaagtattagcccttcttcccaaagtatgtgtgagcatccaggttgtgggaaagtatcaacacagcacagggaacatcaaagttgtacagtaaatgatagtctccttgctgccaatggaaaaacttttgatcttggacccagaagaactaggtttgagacaatgtttttagcaaattatttaatctctctaaatctccacatcctcatctattaaatggagatgatagtttctatctctcagggttgtgagaatcaaatgagataacacatgttaagaagaagtgctttctgtaaaggcattattatttgtccttttaggttcagctgaaatcccacctccctgacttttgaaccaagaggctgcctaagattctcaatcttcctttttctggaagctaaggtgttgctgtttctttatttcttgccaaagccactatctcctacagttaagcagtgaaaagagtattcgcctaggaagagcagggttctagccctagctctgccactgattagctgggttgctctaggcaagtaacttacctgctcaagtgtctgtttccagatctgtgaaaggggaacagtgacagtacctgtcttgcctacctcacttggttgcaaggatggaattagatagggatcccctgtgtgtttccggacttctaagtgtctgctcactgactataaacccttaaatggcttatgtaggcattggctttgtgacattgggcaaatgacatattatttctgagcgtcagtttccacatctctaaactgtgtaaacaatacctactttattttgttgttaggaagagtataatgaactaatatatgaaaggtttttgatagagcaccaggcacaaaaagcacagcaagactcatatatcagatgccattgtcagagcattgactccagattgccttttccctacctggcttttcctctctgcctcttcttcgaggaaggggccaatggcagagggaagctttgtgcatgcagatattggcgttaatgccatagcctgtgctgggattgcttttgcttcaggatggcttcccttggcccctgatgacgaggttatgtgttgatgatgcttttgttggagagcacaagggttagtaatgaaatccagcatctttcacctgaccctcctgatccaaaggcatgatgtgtgcggtttcagcatcctgccctcttcccatcttcctttcctgtgccagaatacttgcaattctttaactttttctccacaatcaggtcaggattaaaatgcacgtgggagggactaatataaaaactgccactaaaggtctaatcagggcaagtcctgagaaggtggggaaaggggggtgcaggggtaggtgtcctgaaggttggaagtcagggagagagggaaacagggattagataaaggaagcagagaagggagacatgacgagaaaaatagtttcactcatttcacaatttttctgaaggttcttcttgaccatcaacagctgttggacgattcatcctttaatccgagtatatgatgcttaatccatccacggagctggatagtctgtctttttaaatgaagtatgttgtaaaatcaaaacagtgcttctgccccaaatcttgagggatttgagaggcatgctcacattccatgaatcccaaaatacagattttctgtccaaatagcaggctgcaaagccaaacaaaaggagaagcagcctctgggatctcagatggcaggacagaacgagccagctagagctgattggattgaggccttgaaacctatgaacttcgctggatgcttttttattttatcttatttatatttttatagagacagggtctcactatattgcccgggctggtcttgaactcctgggcccaggtgattctcccatctgggactacaggtccaaatactaccatgcctggcttagatgctttttaaaaaaataaaaaacatacttgtttcttcattaaatacgcaatataggttatttatagaaacacaagaaaatacagataagcattacaaagcaaaacaaaaaccaaaaaaactccctttaacctcactaccatgcaactgctaacatttttgagtagaaggagacaggacagtcattggtggttaagtgccatgattctggggcccaccttcccagtgcaaagcccgacttccccatttacctgctggaggccacaggtaaattacttggcctctatggggcagtttcctcatatgtaaattaggtataataataataataataatgcctacttccaagggcagttgtgtgagtttaaataagccaaggtagtactgcttaaaacagtccttgtaagcactatgtctgtgatacctataataatagttattatgcatctagcctttctcctatataatttataggaagtattatgtataatacatttctgtgaaaatagaattgtcctgtactgttttgtaactttttaactcttatgattgtcttttcatggccatctttttaattagtattagctaacattgattgcttacagttggaacaggcttagtgctaaagattttacataaattatcacatttagtcctcacagttaactctgtagggtaagcactattgttaccattttacagatgaggagactgaggctaagcagtttaaatgatttatttacagagctaacaagcagagaagttagaactccaatctaaacattctggcttttaaatattgcccgtgctagaacttgccatggactttataagaaagtccaggatttctttaggacttctaaaagaggcaggcttcagtgcgtgtcatctttcgttccatcctgcagcaaagaggagaatgaggctgagacagcctggcaacctatgctggcagggcttagagagaaaatgtttgtgcccactcctttttaatccttgacagaacgcacgttggtactctagactgttgggtgtctggctaactgttctggggctgtaatggcattttcagtttttactgtggaaatcactttctggtatgaagcgggatctagggttcagtactactcttaattttttctgattgtgtcttatgcagaaaaagaaccttaaagcagtttttttatcttgttctccagagcccttgacaaagccatctgagccactgatcatagcttccttacccttctctttccatccctggacattcacccctatccccagatattccagggctaggtcccaggcattggtagttaatttaatcagccagtctttgcccagactccacccatgtgaagccctgttctggcctccacagggaatgcaagaggaggactttggttgtgaagacaccaacacacacaaaagcagagctaacaatacaaagcaggttgtgtgtggctcagacaactggtgtgagcccagatcagtctagtaagggagtgtggctgcactgggggttggggccatggggatgtcctggccagaggtatgataggctgacagtaacctttccgggactaaccccttcttctccacttaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcaggtaaggccagcaggctcccctaggctgggcagatgccagccttaccagcatgttcctatatgcaggggacccttctgctgccagagctggaaagtcaccccactacagaactttcacccacagaaacaccatcatgagtgatttattccttcatgttaaacatctctcttccagcagtgacctttaccgtgaatccagctgtgagaggagggcagggacaggaccagggaagaacatgggcacccagaggctgtggagaacacgggctgggagaaccaaggacggcttttgctgacttctcaatttgttgccatctggccataagacccatcctccacactagattgagtccgcaggaagcattctaatccttaacttccagtgccttctccagaacagcaagaaggtgtgcccggatgatcttttccctctgagaagccagttaggccaagtaaatcatttagtctctctgaacattggtttcctcgtgtataaaatggggttaaacatacttcttgcccagggtgtcggtgagaatggactgaaatgatgtccataaagcacctggcctggctgagctcactcacactggggagtccttgacatcacccctccctcggaaaataactggttctcccctccctagcacctctgcaactccaaagttcacaagacatttgctttttctcagttacattcttcaagaaaccatttcctatgcgtcctgaccagaaacaggtgtcttgagtagtcttctggtttcagatcctaggtgacattctcgtcaggggtgtcagttctgtaaggacgctgggcaacgagttgtgctcctccccacctggtctggtgccacaggtggggacagtgtctgacgggtgagcatgagggaggcactcagggagggaaggttcttttgtggttgtttttcagttttccggagtaagcctggtgccttggagacggtggactccgccatcctgttatgaagtggctattctgggaaagagggaatccagtgtgaggctgggaggccagaccagaatgtactattctggtccctgtagtacaggaaggatatgggggacagactttcagaaaataggacgacagctcagtgggcctggggttggagggctaggcctaaagaggcgaaatgtgcagacaagagcaggagagccaagggggaagatatgctccataaatactttcaaagaacaatgcaagacaatggcagatacatgatcctagatgctgcaaagagagaacagtgggctgagccctggcaaggcttggattgctggatataagaaaggctgggagactccatcacagggcatttgtgtacccctccctttaaaaaggcttgtcttactggataactgagggccaagttggctaatgttgcaatcatctttacataaaaagagtagacagtggaggatttaatgactggatggaggccccttccccacagtgagaaccctctcccctgctttcctgctgtggtacttgagattttgctcttagacattaattcctttggattaatcattgcttctttcatcaccactcccaattcctccacccacacaaagccccagaaggggtaatacaggttgagtatcccttatccgaaatgcttgggagcagaagtgcttttgattttttaattttttcagattttggaatgcttgcattgtatttatcagttgagcatccctaacccaaaaatctgaaatttgaaatggtccaatgagcatttcctttgaatgttgtgttggattttggagcatttcagatttcaggttttcagattagggacagtcaacctgtatattaattgtagaatgcctctgactaaatttggactcgttgtgtttctccttatttcacagataagtgaagcacagacaggttaagattgctcaaagtcacacatttagcacatggtgaacctgcacctggaattcaagtccttttgaattttggtccatgggaaaacagacatgggacagcaagagcattttgtaaacctggtcaggcaaagatgctgacaagggctggggtatggggtgtgggggaagggagaaggtaggggaacaaaggtcaacagaagcagctgggggccagcgtgatggggaggaggtcctcacacattcagagagttgtcctgtccttccccctagtgcagggcttcgttttgcatgcttgccctcctgagcctggctgtccatctcagtggttcaaaggttggcctcgaaaaggccacgagttaggctggactccctgagcacatctacctgtgtgtgttctggtgtgagccctcatgtgctgatgggaacccctgtgtgctaaacacacccacagagataggaccagagtggccacagtgggacatcccatatctatcccatctccggagcctgttgaaagttgtggacacaaacttgcctgccctctggctgggctcggccctagaccagctagagcctttagcctgtcagctctggtcctctctgtcccaaggaaagaaatgaaggaaaaggataaaaagtttctacttttggccatgtggtcctgatgtccttgaaggagaaattctcaccaaacgagcacagcccagggaggaggagatggtttctcagcacccgcttttctctgacttctctcccaggctcctgccacacattcgctagactgattgttaagttattttcagaaattgtaagacaagatctttttctttctaaatcgtattttgcttttccaacacatgtagcgttatgaagaggagtacgggatttgtgggcagatagacctgcattggaatcttagtttggctgccttctttctctgcaatgtagtaaaaatttctctttgagctttagtttcctcatctgcacaaagggaataatggtgcttaccctgcaatgttatttggggattgagataacagatataaaaggccttatcctctagcctgccacatattaagctctcaataagttatagcttagaaataaaaattattatgaacaaatatattgatttatattaaatataggcttctggagaaatgatgtaaaagaaaacccagtgtaaattcttactatcctctaacctactttctagcaatttctatcaaaatgcagagtcgtcaaacttttccaaggcaaaacaacccacacattcattatttaagcatttctaacaaaggtgagtaccaattttggctcactttataataggaaatagctggttgcatacctcaaagttcaaaaggctaaaaaataccaggtttttctttagaaaagtttctctttacttagtaacacgtttccctttgattttcacagtaggctgttctgtgtgggaatgttggagaggaaacctcaacgttgagaaattcaggctgtgggtctgggctgccgattgagattcgtatcacaggaagcaaactgaaacaatagctttatgatattagctgccacgctgggctgaggacagaacacactcttacaggaacatcggtggaaatgccacttgattgtcctaaatcctctttcaagatgagccccacaaaccatgagcgaatcagggtcaactctgcattctgagggcattaaaccgcagtgaatatacaaaatttgcttttcattgtaaaactgaattttgggcttgcccaaactcatacatggcgaaatcaaattcattttccatggacctggagatcagcgtgaagcaaggtttctaaagagaagtgtcagttgcattatggattcatcatcatttgcttagcgaagacatcagttataacaagagattatattttcctgatctctagactactaagggaaggatattaaaatgtgagacaagtgattttaaagtttttaaggcttgatatgacctttccatgcaggaaaagtgggacaaagaaagaattgtggaggcagatatatgttctggtaccctctcacaccccactttcagacttcttttcccaggctttcactcctacctccacccctttgtcccacccactccaaatcaaggcctttttctgtcctgtttggaaagaactcaataagctgattcatgtgaggatgttaatgggtgagaacagctaatatacagtctcttctagagatactgactttgttcagatcattcctttaacttaaactaaaaagtctcgtcagtcaacaggtgtttgctgaacccagtcctgtactacatcaagggtaatacagagaggcaagataggatagtaagatacatgcaaagaacaaaggcatgaatctctcctagtggactttcaggactctcagggagcccaggaagatcaggaaggacacagtgccttctgtcaaaggcatcagaggagcccaggcctgctaatggtggcatttaaaggtatggctaaggatccagtaagcgatcccagagtgatttccctgtggcttgactggcactgctcttgcagtctgcacatccgggagggcggggtttgaggggccaggctgtgggtcaggtggaggggaggaatcagtttaggcagagccttagaaggaaggcccctgtggtggtcacaaagtggtaactgccaagcacatctgaaccaggaagaccccatcagaatggctttaagaacagtcagagcagtcctggaacttctcggagtaggaaacaagaggcaaagcgaccttggtggaataaaagtgcagccagcattctgaccagcagcaccgtggggcagcctggtctctgagaccactcaggagcctctgctctgccactctgcctgctctctcccaatgcacagcccctgctgcccaggaagtcccaccccacatgggcggtgctgcctgaaggaaatgagcgttgctccggaaaaagtgctccaaaacctcagcccgcgcatatcctggctgtggggagtcatcaaagcctgtttaccggggctatttttagcattaaagaatcttgttatgctccccaggacgggcatgcactttctcagcagagcacctctggttttaatgagccatctctcgtctttggggtcagaccctgaagggtcctcggaagcaagtaactgagatctggagcccaggatgatttacagacccacttggtggcttattgagcacctactctgggctcctcactttgttctgaccaagagttgatgctggattgtggcatcaccttacagcagtttatctgtcttccccaccagtctgtcgattccgagggaaggaactgcccttacacctttcagtatccctgattctccttaagacaggactgagcacacagtaagtgacacttctggacagattaccttgtgcctagcataaagcagacatgaacacagtagaaacttaataatggtgtagggagcgcgtgcattttcccatgtccgtaacactgagtaggatattaatggtacgtcagggaagacacgatgttcataggggaagaggcagaagggtcttcagcagatttgtgacatgagcctccacggtgaggggctacctcctggctccccagttttcactctcagctccaagctgggagtgacctggccaggttccttcagaagctcccaggagaacaagcaggtgctgtgagggcaactagttccacagagggaagagaccctgtcccggccctgccgtcacagggtccctggggccaacctgctggcttcctggtcctccagccattgtgaccgcagtcccaagacattctgttacccttcgtggccctagattgcccctctccctcccggaggccagctgacccgatgctgctgtagccgatttcgccacctcctggaagcaaatgcactgggcatgggtggaaaccagtttggctgtgttggaactgttaaaaacaggaaattttaagcaggactatttcctctgggactagttaacccaaatagggttgtcttgggattacttcagattttgaagtcagcgttaccactgagatcaaagaaattgaagagaaaatatcttctcggttggctagaaaccacagggttggcctctgtgtatctacagaaggtggtcacctatctggtgtgattgaagtggcgctgaaaacctctcctcactcatctccaaaataagtcaccacctgccagcacagggtaattaaggtcactcgtaggatctttgagttgaggccatagctctcagcatgtggtcctatgagtagcagggtcagcgtcacctgggaactttttagaaaaacagattctcagttctactgaaccaggaacccagcaggggcccgtccagggccagcttcatgggcgtgcagcacaggcagtcttagagggcgccacacttagaaagttctcaggcttggtttaatttttccaatgagaggtctcacatttttattttgcactgggccacgcaaattatgtagcagtgctggtctcagaaatgtttctttcagcctggcctatagatgattctgatgcatactcaaatttgaaagcactgagttaagtcattttctcccctaaagcccctgttcaaatgaagattttagctgggaaagctaacattcacagtggcatcgcccacacctgggacattgcatcatcgcttcagcgggctgatgagctggcagagaacaggtgtatcagcagaaaccccaagcagggatcaggtgtgcgtatgtgtatggtgtaaggtcattcccatgacctgtggttctcccctctccaggctagccgcctgaaccagggtgtgcagaggaaagaatttcccttgtttcaccattttagcagaacagagggaaagccaccggggcattactctgtacaacccaactcttggctctgaagccttgcccatccccggacaggacccactgtgatcctctgcaaaaggcatctgtgactctggcgtgttctctgatcctgtgtcctgaaagatagctggtcccctttgccttcactgaagcctcttggtaggaagatcttgtaatgtggatttgttcttcttgaggaataacagcaggtaacccaaagcttaaatttagaggctccaggaaaaagataaaagagaaacccagttcccttgcagaaaggcccttgaacgacatttcacagcattgatgtgtccctggccaagtggcccataaattgaattgcattctacattccttagaatagtctccatttggaagactccttttagttcagtgaatgttaatgtttgcaactgacatattactctcatccacttgttctgtaaatcaagtgaggcatattttgattgatgtttgcactggataaatacaaattttcataagtaaatgtctttggagttaaataatgaactaggagaagagggctgaaataaagtctgtggtttgtgtataacaaccaaaggcctggggcctaagaggtttcttttggtctgggacaagagccgagtctatatttttcagatagcagaggtatactagatagggcaggatactcaaagtgtgggtggttccgggtggaagttttcctaggctgcacccagcaaccacctgtacggcctgctgagaatgcagttgcctgctcactctgttttgcacctctgggcttcactctctccaaaccattctgtacgccattgccagactaatctccccaaagcagtgctttgagatgcactcctctgatcacatttgcttgacatgtgaggcccctccaggacactgggcctgcctcaccagcccaatctctgagactgggaaatggattctcttcttcagccagatgggcctctcttcagtcctaggactgaagcttgctccaggtgttttccagtgttcacacaatcccgtctggttcagaaggcccttcttgcattccacagagtgaaatctgttttttctaagactcttcaaatcttctttgcaacagttagttgtctgtgatcaccccaaagcgaccccctcgtcctctgaccccttagagctcttcccatctacacttttccttgggagcccagctatgacacccttgaacttttatttagctttgcatctctgagtgctacatattcctcacctgggatctgagcaatttgagggtagtgcatgtcttggagcagaaagaagaaagaatttactgttcttatagttttaggcactttacgtacttatccttacaattcagagatggaaattgttattcccatttagctgatgaggaaagtgatatccaaagaggttgttacttatccagagtcatagcctaataggaggctgatctaggaatagaacctgtgtttaactccaaagcctatgaatggttgagtgtggcttctggattcagctgtcaaagcttgctagctttgcaatctttatacctttggacaaatggcttaacctctctacacttcatctgtaaaatgagattaagaatagtagctacctcgtcggtcactgtgaagattacatagcatgcttagtgcagtacctttcatgtagtaattgcagtatatattagcagctaaaatttgttcctactactacgactaccattatattcaggcatactttgattgatgtttgcactggataaatacagattttcataagtaaatgtctttggagataaataatgaactaggagaagagggctagagggctgaaataaagtctatggtctgtgtataacagccaaaggcctggggcctaaaaggtttttgtggtctgggacaagagctgagtctataggctgtacaggtggttgctgggggcagcttgggaaaacttccaccctgaaccactcacacagcagctcctactgctctcattactagtgccagaagtactgttgtcacaacaagcacactgtcctcacagctcccgtcagggtgtcctctgtgcagtggtgcctgctgccaggcggaggcagacattcagatggttggcagtatgcgtttccagaaaagtccacccaatgcctttgcaccatccctggcaaatgcctatctgtgccagtcccatctgttttcactccacattcatgcaagctgtcccacccccccccctttccagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtgacaccctcctctatctctttcaaaagaagaaatgtttccatttgggggtagaaatgagtggaaggtgctagccacaatcccacttgacctctccctgcaaatgcccacggtgaccctcgctgacctcaggccacacgcctcaggccacgctcccacccccaagcattgggtttggctttgctcatgtccatcctggtagacagctctctactgactcattaacagaccaagtctctgtcatcatcagtagtccccgattacatctttctgtctgtggacctgacactggactgggattatgagaaaacccaattcagtctcctccctgcctccaaatctggaaggtggctcagcttactcttggagtcttttacttcactgttaggaataatgatgcctaaccttgtttttgaaacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaaaaaatttaagtatgtagcctgtgagatgagattggggcattgagaggatccagtactcagaaatatctcctgctggccctgcatggtgcctggtgtcccactactaggggacacctttgggttaggacactgtctctaggaggtttcatcacccaagagtcaagcatctctgccaaatgacaccacccaaaccaatgaggaactagtctgtgccaaagtgctcatagtaactactgtagttatctattgctgtctaacaaaccacctataacatagggctttgatgattatctcccagggttctgtgggttcagtgggtgggtcttgtactccatgtgatgtcagctgggctgcagtcatctgggggccagactaggctggggtgatcaggatagctcacacacgtctgggaccttgtggcaggtggctggaaccctggactcagttggcatgctgggacaacaggactgttctctcactctatggagactcagagactctccctctccatatggtgtctctagggtagccagacatcttacgtggcagtttagggctcccagaagcactaaagtggaagctgccaggccttctgaaggctttgtccccagattggcagagcatcacttctgccccatcttgttggttagagcatgttacaggccagccctggctcattgtgggaggaaactacacgaagccatgagtgtcaaaaggcatggcttgttggagctacttttggagaagagctaccacaggaaatggtaccctgatgagacgcaggtcaagtaggttttgatggagaagaggtttaaaaagatgtagcattcaggaccttacccatggggatacccagcaggtgccagtagatgagaggacccacacaggcagaaagcacgttgcaatggttgcaatggcagtggagcttcctgtcttgtaactgtggccattcaacaaaggcatgaatagggacattgttaagaggactgaagctttggtcagaattggggcttaatgactgtcaaggtcccttccaaacctgagattctgtcactggtctggggagattctgtgcatgtctagatgtcctctttaacaacctcacctgtcactgccatggggcttgtgcttgtccagcctgaataacagaggcagtgaggctaagcctacaaggtttggctcttattaccacacacgctgcaaaaacagacacttcattggctcacctccaccctattacagactgagtctgcagtccacatttgggcctgcaaagtacagaatcacaaccacctcctcttctaccactgccacagctccctcacccagctcctctgctctctcttctgcaggccttagaccacctgggtcctagggtacactggcagagagcaccctgtaggctgctcagtgtcttgtctggttctgtggggaaagggctaccagactttctaaagctctctaaaaagaggattcatgttctgcatgggtaggtgcttgaagcctgagaaagcctgagaaaaccaaagactgatttcttctgtactccagaaaccctttggcctttgggttcttagtgtcagttcagccactgaccatagtctgagtttgagtctgtgaccagaagcaagtaccctacttctctgttcctcagagtctttcttttcaaattgatggtattggactaggcaaaggcgacaacctttcagttctcaagtgccatgattcacagccaagtgacctctaattatctgagtagaactttagatctcttgatctgcatattgaggacttgggatcagtcaaactcaatgcaacagcaaatcttcactgaaggtgccagcctatgggtggactcgtgatctagacctaaagggttagtgtgagttcctagaggaaaagaaagccatgaggcagattgtggaaggctttgaaggccaggtggagggccttgaactttattccatagacaatggggagctattgaaggtttctgtgcaggggtggagtgatctgtgtggagcagtgtttagaaagaatgaacaaggccaggcacggtggctcacgcctgtaatcccaggactttcggaggccaaggtgggtggatcacgagatcaagagatcgagaccatcctggccaacatggtgaaaccccatctctaccaaaaatacaaaaattagctgggcgtggtggcgcgtgcctgtagtcccagctacttgggaggctgaggcaggagaatcacttgaacccaggaggcagaggttgcagtgagccaagatcacgccactgcactccagcctggcgacagagcaagattctgtctcaaaaaaaaaaaaaaaaaaaaaaaagatcaaatgtcagcatggggagaatccagaggttagcaagttaagaggcctcaataataccccagcaacagccacaaatgaatccctccagcccccttatacccaacaactggtctggtcctggtggtggggccagatcccaagatacaggtatatctcattgtatgctaaccccacctctgaaaattaaaatggcaagaatcataatttggtatgggagaaatggttttataatcgtgatgaaggaatgttctctcttttttaaaaaaattcactattcagtctgttactgagtggggtcccctaaggatgttgaagttttgttcaagggtgccacagttcctttgacacataactcttcaggaatatgtcagtcaagatcctctggaagtttaagtgcaggggctggtgactgttcctggaggaaggagtgtgactattcgaaacaaggctctagattgttctatgatgctgggtagggggcaggattatatctttgaaagtaggtaccagagatggtggtgtaggcaggatttagacacagacaagtgggattcagctggcactcttcattactttgttttacaaaaagtggaaaatggttctgaatcgggaggctgtttggcaactataaggaagtaagctatattgctggtcttggtgatttaatttttgctgagagagaggatatgatccaggttgagttaatccataaagtggacttgctcaccaagtccactgtaaggagattcgtaccagagttctctctagagccttgatacatatgtcacttcagggacaaagctaatggcatggtatcctgaacacagctattgcagtttgcaaatggggtacaggaggggttaaattcctcctgagagacaggttataaaggaaagacgggagtgtcggagagacatttctaacctgtgaggaaggcttacacccttggagtaactgtggcctcactcagactgtcccttggaatttctgcgagaagacctgggcctgccccaggaaagggtggctgagttagtggctgataggcagtcgttgtgtcgctgctctgaaggcaccactgaccatgttccagatgcaatgggaaatcaaatgatggagcagctcctcccttgtgggagtttatgctccagttgaggagataagcttgagagtgggaaccattagttcacaggccatgatggagctcagtgttgatggcagaccacaggtgctaagagagcagatatttggaaaatataaacaataggctgccaagaaaaactgcagctgggcccctctcatgaatatccatataaaactgacttcagctggttcttcccatccttccacatccaggctctggttttgggaaaaaaagcaaagacatgtccacagagcgggacttcttcatgaggatgaagtgcacggtcaccaacagaggccgtactgtcaacctcaagtcagccacctggaaggtagggcaacatcaggcctgggttggagtcccaggtgtagggtaacggcggtgcaggggatgcctaaggccctacccccacccccagcactctcggctccatgtctgacccttccacgcctgtctcaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacaggtagggggccatgggtgtgtatgctgtgggcagagatgggtcttacctgtgtgtgtggggagttgtgcctgtattaaaggtgtggaactgaacatagacgtggtattgccgggtgcatgttcgtggacctgtgccactgtttcattgcatcagtgcccctcagaggttcccggtactgtatttggtggtctcccattgacagagcctcagggtccatctgcagagctttcctggtgtgcaactcttctcatcattgtggtgtgaacatatttctccatacgtgtatcaggctcctgaggaaattctcaaggcagtcttctgccccaggagaaagagtctagagacttccatctgtactcctgcttcagaggccagtaaggagcatcagcttctgccctggagactgaccctcttccattactgactgagcctttccctccgccttgttccttcctgcatgcaactccattccggccagtgtccagccattttgaagaagatgaaggtagctgagccagatgctaaccccccagtgccaggcccagtgtctcttaggagacacagtagtgattaagagcatgggcttcaggactagatggcttaggttcaaatttagtaataaatgttcagtgttagctcttattatcacctttattagagttgttgaaagagtgcctaagactgcttaggcatgtcatgccatctcgggttcttagctcatttagaagattgaagcaggtggggaagagactggggttgtcataggagggagtatttagataccctacagctcctaactcccccaccagccctgcctctgggactgtggagcctgatgatgggaggtaggaggaggaagatggggagaacagatgcccggagcaatggccggccccagggagggaaggaaatgcagaagactgggcccagggtaggcctggcttgagtaagcgccactggggcttgctgagcagcaccccccgcatgcgcccttcctggcagagatctccctgcctgacctcagctttctgcagcatctagagccgccatgtgtcccagggtgacagttcctgtggcagctctttgccacccccaactctttgccactcttctctcatcttctagggtttctcctcaggaaaccctcagatctcagtttccccttctccaaaatagagataacactttctaacctgtttcatggggtcactgtaaaatgagataatggctgtgcaagcactttgagaagtccagacaccacaacacatgtgaggcttcttgttattgcttatatcttacttcctgtccttggcctcctccaaagcaaaatcttccactaaactcaaggagctgaaaccacttctgaaggcagttagtggctggggggcaggaagaggaagaatctgacccccagatcagcaagaatctgccttgtcttcctcagctagcaggaaaccatggaaccccaggaaaaaaagctcctgctcagcctcccctaggcctacccacttttctcttatcagctggacatcccaagggcatctggtttcttcatgggagggaccctcctctccaggatggggtttctctcctctgattccagaccggcctggtgttggttggtcgccccttcttagagttggccaccacttgtggcacaatttcagaacttttgtaaaagtatccttgagtcattcctgtccttcagttctgaccacagtagggccaggattcacagcctttggagctagtgggtagttatataagtagaaagaaatgctctaacctcatagggagaaaatgtcatgcatgaagccttccgtcctggaacttcgacacagtcaccatttattgtaattgttagtggtggtggtggtggtggtggtagtggtggtggtggtggtggtggtggtggtggtggtggtggtgataatgatggtggttcaagaagaagattgcacttttagtgacaggcactgcaggaatccatgttataggtaaggttatttatcagatgcagtctttgtattcaggtgaacattctgggcagaagacacagctttgtgtacctcagtagtcttgtgagataacatggacaatcccactgcatagcccctgtgtcactggctttgaggtgaagtggctcaagccgacgtagccatatagcctgggagcatatatagtgctggggatgatgaaagtcagatacgtgcttcaccctggtgaatgaagcacatccgtaacataactccataagcactgggaaaaccctactgtcctagaaaataacttggcatccctacataatagaaaagagattttttttaagcttaagattttgatccttgttacagtgagaagaaatcctctggaaggggtaattcagccttatcctttattcattatcttggtttaaatgagtttcaggtaattttctgaaggtactaacctttggacaaaagaagagggggagaaacacaaggaattggatgtctaaatgtggctggagaggaaatgtacatagaaaggggaaagatgctgtgctgacttcttagtttggctcagggctggtagccagagtagcttctggcttaaaggaagtatcaagcctcgtgatttagggctttgtgactcataatgtagagggtgatattgcttataagttctgcgagacacactgcattttcagcaaaatcttgcctttcaagaaacctaattacatggccccaagtctgaattcagtggtgctggagagctgcatgtagaagcatttaaagacatagaatgctgtgtcacacagaagttgtgtttaaccgattagcagattagttaacaagggcacagacatggcttagacagttgatgaagtgactattttaagtccttaatccctaagtgttatatcttaattgctttgatgaggcctgagatatttttggttttggtagcttgttttgttttcactctttgtggtgggatggggagaagcatatgcacatgcacacatatatacactctccgcctcaattcccctttagagacaaatcctgcaaaaaccaatgcctgtccaagatacctaatggggtgaggggttctccattttaatcaggaaattcactaggtttaatgacatctgagacacacaaggtgctgtgattcccacaaaggggattgttttcctacaagaaaagttagaatctgaagaaaatgtatggcagttagaatccacaaaatcaattttgaagcagtttggtacttgtcttatatatactgagaccacagacacaatcaagcaaaaaaagaaaaagggtcatggagaaaaagatgaaaaccgacaggaaagaagggagagaaaagacaactctaattttacattgaactctcaggtcaaatcagttgaatctgaaacaacctattctgaaacatctgaaatagaataaaggaatacagatggttcaaaatgcatttgtcctcctgttaatgagggatcagagtaccatattaagtcctgcattaattgtttttaaaatagtaaatacttttaaaagtaaatttcataacaattcatgtcggtcacatttatgtacctatggtcaactgctctagacaaggggagcaagttgagtagcagggtaaaagaaaaatatcctgattattaatggaattaatgatctcttcttcatttacgactcaaacataggcaatatactctgtttcccgaaatactgagcaaccagttacgaactgtcatttactgtgcatctgctatgtaactgtgtgccagagaccattacatcaaagtaaaagagatgattcctgatcttcaggagttgagagtttgagacataagccatttaatgaaaccacagtgaatggtacaaaatacaacattccatttacccaaaaggaagacaaaagttgttcccaagtagtttaactttaaaatagggtggttcttaaattcatgtggaggtgccatctagtggtgaaagaggtaactgtgaaggaagccaagccgtcagggagatagaggccaggcctttctaattatcatataatcccactgcgattttgtcagttgtaggagtcttcctgtatcttagaaataaattataaaaccaaattatgtggataggagcagtatcaccaggggaagaggtttcaaaattacagtaaaaatttcaaatcaacaaagagggtcatacaatttttacaggtaaagaactttagggcaaccctgttttgtcattgcatttagggaacataggacatattaatatcaggagttacagttgaataaagatgcctacattccaagttctgtggataaatttatggtgaattgtttttctacaaagaagttgagaataagtaaaaatggtgaaagtgagggaaacgttgaggatcctaaagataatgtcagtaaggagaactataaagagccataagtggtaaaacacacacacaaccttcctatgtatactcttacccctacaggtaccctgtaacactccacagacaggatagaaatggatttcccgttaattacagagctggttgtatagatttcatataaccatgtagtatttgaggaaaacacaaggcttaagtactgtttaaagcaaacaaaatctagatgaaaatatattaaaaccaaccgaaggcactgaaatctgagttagtgaacagcgtacatattagtaaggaaacgcagtgtcaaagcttataagcacatatagaaaccaaaatgagataaatcacggggtgctgaggagaggcgatgggcagagtgtggaaggaaagcaagccgacttgaagtatttattagcagatacattctttggaaaacaaataggtggttacaaagtacttaaaactttcatcctcttaaacagtttaaatactctctcaccatcttgcttacatgattaatttacctagcaaatcctttactcgtgtagggaacaggggtaaaaactgcagccagatcttgcgtgactccaggcggtggcatctgaagtcaggcaccgtggcgctgcaccgcacgtggacgggtgctggcgattacatgcggggaagaagagcgagccttctcaggcctgtgggtggatttctttctgccacttgaggtggcagcactcacgctgtagccaagagaataatttttttgcgagcactctgctgtaggtggtgtattttgaatagagcttctaaacagttttgagagtaaagagcaatgaatcattcattttacattttgaaggcacatctcactctgaagtccagtgctcagagagctgacccacgtatttacttggggtaacaccaacttcagaatttaacaaccccctttaaagctgtattttctatttcctttcatccttcctctgcctccttgtggctgactatctatctgcatctctctcctcactgcatccttggtctgctgttttttgactttattattaaaaagtatcctctgttcttatgtttgaaatctggtgaattaagtccttgtacatttctctcttctcttagaacagccctactgagttgactttgaaatttacgggtgacctcaaactgattttctttttcccagtgagtcaggggtccttaattagaaagaaagaaaaaaaaatagttccctggcccctgatggagagagcagatgaacttgtgttatcacagcccagctcggaaggcttgtctggagcctgggggaaatgagcggggaaggcccttgtgtgccgtaggagcgaccttataaacaagctcggttcattaacctccccactggcgtctacgtgcctgcacgtgggggcgaatgaccatgagctttaagttggggtttcctggctttgtgaagtttgacaactcaaatgttcttcaattgtgtttgggatgtggtgtatttcccagtttttatagtagtctgtttaaaggaatgaagaaagacattaaatatttattttagttgacaagataaatgaaagctgctactgggaagatatctggcagttctgaaatctaggtttgtttttccacttccaaaacatgcccattgtatgcctttgaatggatgatacattaattagataaacattttattatgaggcagattataataaacatctactttgaacattttaatttaaagattctaatctcgaaaggaaatttaattccttcagagagtagaaagacatctttcctagaatgccagtaggctcattttggagggtctctagaaaattctagacctgcccaggaacagaagcagtttatctggcaagtcagtgagcctgcagatggccagaccattgttagcagggcttactcatgcagttctagttcccaggctaagcttgaaagtcatccgacccagcagcgaagccatttgatcgtaggaccagcactgttctgtctccttgttccccccagtctccacctttgccaaggtgtacttgggcgccagccccagggtcaggttgccagataatgtatccattgctaatgagttcagagacctctctgctcagggccaagcgacgggacagatccttctgctctgagactggctggctggcacaaatgagctgctaggatctcactggagaaatctccactgggctgaatcagctgagacctaagcctctcagccctgttgagctgctccttgtttgacaaaggctttaacccccaaattctcacccaagcagagaacttgcctcttctctgcccacttcaaaaccagatgacttacagaatgaagaaaggatggatagactatcatgacaggttctgtgtgtgtgtgtgtgcgcgtgcatgtgtgcgcacacacattgagacagttaatcatattattctagaaaaaaaaagtagatccttagtgcccaggttccttagcagtgctgggataaacaggtgtctgtttgtaccgtaggttcaaagagaaaatcaatctactggtcagctgttgaggtttttactaagcacccgttatagaggaagcaaaaggagaaagtggtccctgagttcaggggttgacagcctaggatgtgaggagacaaatgcataattttctgtaatattgtgcatactccttaggacttcacgagagacgttgtgctggaggaactggagagggctctgtggagaagatgaggctttagctggtcctggaggtgtcagggcttggagaagaggggagaagagaaggcataaagcttctgcagcaagaatgagttttccaggcatagggaactgaggggagaggggtcttccatgacagagggtacataacattttacagatgagttgaaaatcaaattgctcaaaagatggagagtaggttctggggggacttggaagttacgcagcatttactgttggtgtggttggcaaaagtgaaagctgtagatacttaaataagagtatggcaggttgcaagtagtattttagggcaatttggtctgacagatgtatgcaagttgacctgtttggggggtgggtttagagcagagacaggaaatgaggagccactgcttctgctttctgcttctgctttcctctccgtgttattgatcccctacaaggataaattataggactgtatccaggagtcatgccttctgaagtagagttgtaataatgagactgtggcatcacttctaacttgtgataggccaagtaaacaagacagtgaagccattatttaaagtctgtgagagaaccaagattttgagagataatatggaggtattatatagcctaggataggacatgatattgggtaaagcggccaacctggtggttcttaggcagggctttgtttattttagtgattacagcacaaaacaaagggtcctaagaatgttaagtgattcttcatggttctccacatttgccctttcctctgcccacttcccatcaaaaccagataccttacagaatgaagaaagggacactgaaatgacagccagtggtgtcatctgagctgcctattagagtataataaggcacatttctatgactatgatttaatatttcttcctctcagcacctccttgcctccctcgtttccttgaaatgtgaggcacaagtagaaagtgtccgagggcacctgaggtcacaggcaggacctgcagaaaagtgaaggtttaagcacagacgggttctgcctgcctggactccctctcacgtgctggttgacacagagacaaaggtggctctacctggggccacataattttcatgtttcatttatactgccttctactagaatgagcttgatgtagcaactggaggccccagttttcattcttgctctgtccctggacacctgtgtaggcatcgagcaaattgtctgcccgtcctggatgtctactccctcatctgcaaaaacttggggtgagccccttccagtggttcttggagaacagacatatgtgtgtaccggggtggtggggagagggagtcctcagaactggtgcttttctctcctcccaaacatggcttcaggaagggcaggaacaacaggggtttggttaaacctgcaactgtagattgagcacagtgttcttttgcttggatacatggtacaacaagaaagtctggattgtgttcatctgcatgtgtgtgtttgatttgccttctggggttagctcctgcccacatgctgtgctaagttaatatggtctttcttccttacatgctgcctttttaaaaactcagaatcacagaactgattggttaccaccctgaggagctgcttggccgctcagcctatgaattctaccatgcgctagactccgagaacatgaccaagagtcaccagaactgtgagttccaggagtgccccttgtggcttccttgtgtctgtggtatgtggccttgagtggggtgtgactggtgagacagaagaccaggtcacttcctccacagagctgctgtcttgtgtggcagacaagacttatgccctcaagatggttagaaaaccaaggctgccaccagcctatagactccttcgtgcaaattagaaaaaggacacttcctccagggagatgcacccgtgccaaggtgcacagctgaggcagtggagggtgggttgagtctcagtcccccataccacctccacggagtgcctgtgtgcagtcagtggtttgcacaccttgtggaacagcactgtagagagtaaaataattcaacatatcatcaacttgggtgcatgctatagattcaagtacatacattcacagaagaggagggcagggggagttgaggaaaggacacttgagttggaccttgaaggatcggggaggcttaggctgaacagaggggaaagtattacgggtccaacttaacacatatgttgaggtaggccacagttctcagagagcttgcttgctggatcaagggagctttagaaaaggctgtccaggcaacccagggatggcgtatggaaactctgctttgcagtttgaaagaagcctgagttatgtaaggactctggaagagggctgccacatagaactttctgcagtggaaatgttcttgaaatgtggctagagaaaccgaggaactgaactttatacaatgtagttttaattaatttaaatgtaaatatccacacttggcttgtagctaccatattggacagagaagttctagagtgtatccttggccatgttcccaattcaggcttcctataggcaggtgatccaggaccgttcccttgaatccatgcgactcatcactgtgcaagggctctgggcctataaccctgtacttggcccactgggggtgatataaattggtagaattgattcctgccctaagtgaccttatttctgaggaaaaaagaggaccgtgggctccttgggaacaaggggctcatatctttaacctcagtatctagcatagcgtctggtacagaacaggcactaaatgcactatataaaccgatgggcaagactgtatttggaaaagaatgcttcaaaacgagtgcccacagtggtgcagacagtggtgctgagaggattatgggaggattaaaaacgggtaaagtaagtctgagaagattcccagtggccctgctggcaatggagaaaacggaagggcagccatttgtccatggctcctaaatccacccatctaccccaaggctaagacagccaagttcagtgcagccagcagagtcacaaccccgcaagctgtatgtgaacatggttaacccactcttaaggagtgagatctttcttttcttttattggttcctctgcctcttcctcatggcttttgggtttgatttgacagtacaacagggcccattatgatatctcagagaagtttctcactgtgctctctggcaaaacacacacgcgcacacacagacacacacacacaaacaacctagattcagccccactcaggaacccagagatggggtaggagtggaggtactcttttatgcctgtgaatgtgaccccaccttagcctgcccaagctttgaaattgtaacatctggttccagccttccctttgggattccttcatgcttcctggtccctgaggggttcctgttttcaaaggcaggtgacagaatcatccaggcactgggacttagcggcccaggctctggcccagccgacccactgattccctagggcctggatttctggaccttcctgactttagatgtaaaactggggaaaagtctagccttccttccaagctaagggtgaagccaaggcaagagacaaatgtaaaaatttctgggaattcttggaggacagtattaccttttatcttgtaggatgggaaagcagaagaagctactgtcaaaggaaaaaaaaattgtgacttctgactaggcatatagaaaggattttccctcttgttcttcttagaacatcttcaatccataaaaagggctaggataaaaatggtttatgttttctgctgactctagggaaaataaggtgctttttactgaatccgtgtatttacttattaggcacactgaaaggtaactcacagcccaaatagaaatcacaggctctctctccccttgatggagccaagtaaagctgccctgagctcagaaacccatagctagcaaagggacaaacccatagctagccaagggaaatctgcttgggttggaaattggattaatgacagttatgacacgagcttgccccttgcccccgacccctgtctctcattcgtccttgaggttttgcaagtcaagtttcactacagactgacacacatgctctagactaactggaggctcaggtttgagacaggtccagattcacacactgggatcccccatttacacacatgtatgtcttagcctgtaaaggtttaccgttgaaatgcctggagaagctcaactagatttagatcattgaaagctgtaatttccaaatggattaataatttatacactgttactctgggcgtgaggttaggggtcagtctccctttgttatatgaggatattatgtgcttttaggctttttatggcctttaatcttattttcctatctattaagtagcaggcccttcaccaaggctggcattaatgaccagatgattagaaagctggcgttaattatattctactgacagagcaggcccttgcctgcaattgttagaaatgcacttaaaacctttgcttgctgcactgtttgatcaaaaagagtaagagccctgaatttggtttgcattaaggaccatctaaataagttaaatacaggcacttgaaattgtgcaagaatcattttactgcagcagaggagcctcagtggcacagataaagggagagcagagaggacaaaagttatttccttggttgagtccatgatggtttaggacagcggcaacagcaagtttggtcttcccagtgatttgtggacccaggtaataaagagaccattgtattaggagccaccagacatgttgtgtagctcagactctgtcactattgtcttgtaagctgtgaagcaaatcataaccctctggccttagtttcctcatgttaaaagaaaatacttatcctccctgtggcacagggttttgtttaaaagattagacaagatgatacaaccattttggaaataatttggcagcttcttataaacatatactttacaggtaagccagcaattgcactcctagctgcacccacgagaaatgaaaatatgtccatacaaagatttatacacaaatgtttatagcagctttattcataataatcaaaaactgaaaacaactcaaacatccatcaacaggcagatggataaacaaattatggtatgtccatgcaacggaatacaactcactgatgaaaaggaataaaccacaaatgcctgcaacgccatgatgaatctcaaaacatgctgagtgtagagaagccagacacaagagtagatactcctatacaattccacttacatggaaatctagaaaagacaattcgaatatatagtggcaaaaagcagaagagtggttgcctggaaccagggtgggaatgaagattaactgcccagaggcataaaaaatggggtggtgggggcggtgatggaaaagtgctatgccttcactgtacctttgtcaaaacttgttgaactgtatacttcaaatgggtgtgtgttttattgaaggtaaatttgaccccaataacatttatttttaaaaattaagagcaaacagaaaaagcttagactaggaatctttaatttgaactataattctgtctactgtttccactgaggtggtctttcagcaaatgactcagtagttttaagcctcagtttcttcagctgtaaagtgggaataacaacaggcaccccatggtgttgcctatgaaatgcagtgatgatgacctaatccttagtgagcgccctatgtgccaggcactgtgctgaatgctttgcagaaacgaattcatcttatcagatagttctgaacactgcaaagcactatacaaatgtaagttacaggaattcttgcactttgcaggtgcttgttaaattgtgaagaagaaagcaaaacataagtgtaaaggattaccaaactgcactagtatgaagagagccatgttcctcagctgtacagggctgatgaatggggaggaggcctgcgagcctaccaggagaaccggggagactctctgtctaccgagagcctggatatcctcccgagtggcccctcatgagactatctaccaacgtgtaacagactgtctgtgacaggccatgggcataatatgtattagtatctctaagaaagaggtggcttttcctatacaaaatttgttggtgacagttggtcaacacttatgtacctgataagccatgtgggtacagtcgatcctcagtacaaatggcagtggtatgctgggtagctaatgatgacagttattaccgttactactattattatcaatatcctgttttgcagaggaggaaaccaaaaccaagaaggattgttcctttccccaaatcccaagctagcaagatttcccgatcctccctccatgccctttcctaacgtctctgtgatttgggagcttctgagctggagttctgtaaattcccaaggaatgggcagttcagaaaaataccaaaaattctaacattattagactttaaagagatttattgattccttttgaatggcagcagatggaacattctggactggggaaggacagtctgtgatgtgaaacccttccccaaggtagacaacaaaagcgttttttaaatgaacacttagtagaacaatctagaagaggaaaaacctcataagtaggaagcctagctgggcggttgggagaaggagtataagtgatttattacagcttatgaagagactgtgtgtgggctgccagggtcccagctctttctcagccccaactgagaaagggtggggtggtttgcctctgcctttgctgtgggtcacaaaccttcagtggcccaaaaggtggcaagcctgacagatgacctggagaaatcaaggatatcaatgttttaaatgcttttattcataagcagggtattggtggtgggtctgctgaaaaaaaaaaacaaaaaaaaacaaaaaaaactgccctgaggtcaggctttctccaggctgcttagaagtccccccacctggagtgcttgacgggatggcgctccttacccagtgtgaaggggcttcttctcattgaaccccatgaagaaagtaaggcaggttctggacttggttctgcttatagctgagctggtctgtgagcctgacttgtccagggattggtgatgggccactgcaaagctgcatagtgagcgggtccctccctcagtagacagccttgggcaagtcatttcacctcttctcacctctttttcctatatttaaaatgaagagttggctgaggtgatccctaagctccctcccaggtcactctccctggtcctcactgtcgtggcgccctgttctgtctgttcccctgcagattagactgccctcccatgcgatctgctgagcctgtggtgcacacccctgccccacctccctaagctcagctctgtttctcctcccctagtgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgaggtaagcatgtgagggctggcgggccttggtgcagggtatgtgggggtgcccaagcttcccagactcaggatgacaggcctaggagatgccaggcctctcagcgccctgggcaccacctcagggaggtcttgcagggctaaccctagtgactgagaggacttcctgtggatgtcttggaacagtgggatactgggttgggatttttttttctgcgctttccctggcatctgtcatttatgccatgcatctgacccaggtggggaggcagatagcacacaatagtcaatattttctgaatggggaaaaaggaaagagaatcgcttatgcttttgggaaaaaaaaaagatgtcatgccttcactctatagtacctggaaagaaagctagaggaagtcatttctagttgtttctacagacagagaaaaacaaaagcatcaggcctcatatataccaccccactcaagtgcaataatatttaataaaacaggatccgaaacagacatacattcagaggatacctctgttgtcactacctccatggctcacacacttctattgtatggttctttataagacgccaatgcctggagtcctacccattttttgtcggagagcttagctatgagggtttccatgcatctaggggagcagaatttttctagaaaatgtggaaagtctgaatggctctttcccccccattagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcggtgggtgcttcttagctaagccaggcccctggaaccccgttggggctgggaagagttcttactataacaggcctccctggctgcagctttttcttaaccagagctaccccagccccccaagtcttgttaatcacctgttagaggccaggccctgctgagcacaaaagaacaccacacgctcctgccctgataagaccatcccatatccgacctcaccaagtgctgtacgaggaggggttaagagaggacacccccctgagggtcgattctccaccatgggtggtgagagtctgagatgagagggaggggagaggtgagggatctgctccgaggccacttggacactgtcaaagagaaggggcagattcctaccagggtctggaaggacagatggcttgttcaggcagagggccaagttggagtaatgttgggaaggatcattccaaaaacacagagaacatattgaggcctgggattaagccctcaaacccacgacttcattaaagtgtctgcctgtccctggggatgtaagtcactggggaccccggcagggttttcagccctcggctgctccaatcctggaaacacccttgaagccccatgctccccagttcgcaacccgctgccaccctctcctggccttgctgtggctgccggaagagtggtgctcaccctggactgtgtcagccccttttagatgggttctacagcggccacgtgaggattgcagctaaagagaatctgaaacgcagcgggcccttggccagtaggtctcgcggcttgttttgtggcagtactgaggcaaatagctcaatagcccaattctcctctccctctcataccttccttgtctacccttccggatctgttcctcagggaagagtggctcctaatatatttagtctctgaaaattaaatgtcccaggagactgttccgtttaaagggagtctctacgttgactcatagccagagtcaaagacccatgtgttccagctgagccccagggtgttgggggggcctagccccaggcatgccttccagaccctcttagggccttctctgcggtttttgggcctcctctgccttggggtgagcccgatggttgtgggtgttcacctcccaggcccttgtctccacagggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacggtgagcagccctcttatggcgaggacacagagagggctccgtatgtatgactgctgccagatggctgaagggacatttgggacaggtactgtccttctcaggttatcacagagccccctagagtggccgtgacacttacctaccaggtatcagagctgttttcttccttttagtgttcatcccccaactccattgaaataagctccttgaagggctttgagcccccagctcagtccccatacagggcagtaacatcccgtatgtggcacagagctgcacagtttgcacagccctgctggccacagcctgtatcctgtttggtcctcaagacaggacaacctgtgaagcgacagtagcctcattttatgatgaggagactggaatttagagaggttgatgaattgacctaattcatacagcttgttaattagcagcccctctacaaatagttgtgtggtggaatggaattgaacctttgggtccaggaaggtatttcttcttccatgctggacttctggggagaccagtgccatatctttgactctgtccccctccttcctggcccctagcccaatagccctgaagactattacacatctttggataacgacctgaagattgaagtgattgagaagctcttcgccatggacacagaggccaaggaccaatgcagtacccaggtagatggctgtggagatcaggctagggtgtgtgcctgctgtctggtggacagcaaaggctcacatccattcttgtagcctcatccctttgttgtaaagagcagtggagacgtttggccaaggcccaggtcccctaaagaggtaggggtacagggtaatggagcctgtggtcaccccctcctcccactgtcaaatccagctcttccagcatatgtgtctcctacttagatagctttcttagcacacatgaaaaccgaaatgataccactgcacctttctttaaacaggccctacatttaacaagcatagccagatgtataaaacatgtataaacataggggacaattaatccctttataaacacattcatcttgtgattttaaaaaaataatcatttttatatgaaatgcactttaaaataaataacatctgtttgacaatttttcatttacataaaacttttcaggaacacatttattacataaggccaatgttcttgcaaaaactatgtaaacaaggataaggtagagggaggggtacgtgttttacaaaaccccagggaaaaccattaatcccccatttgtcttagtcttgagttcaaccagatttctgccttgccacttagtttgtttcttgatcctacttggcacaaatcccagctactctgcaaaacatgcccaattttagcttttctatcaccctccctcctcagcactcctgtagtatatatcatgtggcacttaatcacagctatctgcttctgctccttaaagattgcttagtattgcagtcattagtcagctgacacccactgagggtgtcagtctctgaagttagaaactgttttccgcatctgcttgtattcccctgcttgtatcatgcgtccgtcatgatactgccaccctaagggatgatctgagtatctgctgattggaaccaaagtctctgtccctggggtctggctgttaggctgttactctgcgagagtccacagatggacctgggcacttactgcttgcttaggcccgtgccagcttacaggagggagaagaggacaaaaaaaagccacagtgtgcaccacaggcctaagcattgtaggacaaggataaccaccacaggctggagtaggcagggctgactctgtggaagaggggctgcctcggcttcaagagagaaggcgggctccggacaggtgggatggggagaggagaacatttctcaatgtgcagggtgaagaggggataaacatgggggaaggctggtacatgatacaaggtcgtgtacatgacacagccaagtctgaggttttcctgataggccctcgggagccagtggaggcgtttgagcagcactgtgaaacagtgcttgagatgaatggctctgcaggagctgagttggaatagtgtttgtgaggtcgtaccaacccccttgcctctttgccggtgctgtctcccctcagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtaagtggcagatactcagctgtaccagcagggccgaaccgagaggcacccactagtaagatagctggacccccagggaggcccctgcccctctccccagccatctgataccccatttagcccttctctgagctcagactttggggaatcacctcaagccatgtgaggcctagtgtaggatgggtttttatctgggctgccactgagggcaggcaaagaagtggcttgttgagagccctgtacctcagtgtctcccttcggaccaccaccagagtgcctttcgtatctcggttcatcatctgagccacacagaaaattgagtgatgattttccctggttgaaaacagcaaaaagatacccctgcctccccttgccttttggctgcccccgggtcctcgccactgcagcctctcccagctgtgcctaggctccagaaatgccttcccatctccccagcatgctcatttcaccagctgcgagctcactgggctaaggcacaggggttggtacatgacctgccactcccaggggccgctggtacttgccctttatagagcagccaaactagttttcagtgggagcaaaaggcagaggagagacatgggcagaagaaaccctcctaaggactaacattgcccagccaggcagccatcccccagaccaggaggcttgagcccttcagcatcttatagctgaggaaggagacagagctcgagctcggcctgcaggtgcacagcctgcctctgagactctgccttttgggtctttgagtcatcacaggcatcagcattgggactggaagggcccctaagatgagaaggcactgagtggcatgtggctccagactccctcatagcctgctctctcgggcttggcaggtctgcaaagggttttggggctcgaggcccagacgtgctgagtccggccatggtagccctctccaacaagctgaagctgaagcgacagctggagtatgaagagcaagccttccaggacctgagcggggtgagtcatccccactggccacaggggcctctccatagcccttagggaacccagggctgctgagaggggtggggatgtggcccttccaagccagcatagcccttagggaacccagggctgctgagaggggtggggatgtggcccttccaagccagcaagtgccagccctgttccaggcccacccaacccacccagtctggggacctggttctctggccatttcccctttccatctgcccttcttactcccagggggacccacctggtggcagcacctcacatttgatgtggaaacggatgaagaacctcaggggtgggagctgccctttgatgccggacaagccactgagcgcaaatgtacccaatggtgagcagcggccacaggcctgggcctcctgggggttctggtggaaggactggggctcgggagcccatcctggttcttccattcaccacaggccgtacctgcctctctgagccttgttagaatggggcgatgtcctctgtctctcccgcagtcccacacacccaacttttccatctccactctgacttagatgatgccatcagagggtcctgaaggttggctgtagttctggtgactctgagcaccttttataaaggaaagggatgctagggcttcctggcctctcccctccctcaggccaatgctaccgtcactctctgactttggtctttcagataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggtgggtgtgcccaggatctgtcacccccatcccaggattcgatgccaggggaagcccacgtctactttttttccagcgtctgcacagtgccaggcacagggaggtgcttgacttgaagtcacctatacagggctcaggtctccttggatttagggaacctcctcacaagttccttgtgacatcagtgatcaggccccccagtgggtgggtctgagacacagctaaaaaactcaaactcaggctagaatactgaaggaaagaatgcagaccactaccgactgcccaaagaggactgaacactgaacactgggttggcgacccccagaacactgtaccactgttgacaggagcactttcagaagaaagagcaggcggccacagtggtgagggcctgttgaagaagagaagagaaagttcagagagagagagttgggaagcggtctgggcagaggcaggggatctcccgtctatgcaaggatgagcttgctgcgtggagaagggagtgctccttccctggggctttagggagaaccctcccatgatcaggtgccatccagggctctttccaccctgagaatcccggagccttgccccttcctcagttcttcatgtggatgtgttttggggtgtcactctgagttcaggcaggtgctgagaacatgccaaaacttccttcaggtagaacagcctggaaagctctggtaggcccaccccactggacttggttcaactgcaggcaccaatgcctgccttcaaccctgggccaccttcatcttgacagtatcttgtgaaacatatatgtcttcatgaggtttgtttggcctgaaaataattcgtggtttatggaaaaacataccaggcccctgttctaaaaggcaatttcctcagcaatagagtttggggaaggttatagttctgtgcttcagagtccaggctgtagaaacaccagacagccctggcttaaattctggctctgctgttgagttcaggggctggtatatatttatgtgcagtaagaggtagccagcactattcttcctgttatgtgaagcccacgaattaccttgaatattgaaatcaagggaaaatcatattcttttcaaaagagttgaatcatatcaaactcttttctgaccatgaataagagaagttagcaagggatggtgagcaggtatccattgatactgtccacaggagcagtcaagctggggaggcaggcatggaccccagcaaggatctgagctaggaggtgcaggaggcaatggccactggaacgaggctctgcagataagggaaggtgggtgggcatctcccatcggaggggcagaatgcagggcttccaggctctctgctgccacctaagcctttcctccttgggatgggggcctgtgtgtgtgctgcgagtgtcccccctgccactccctggtctgcctcctcggcaagagaatagcacagaggcaagaagaaaggactgctgagggtggtgaccagaaactggattttcagactgttgaatcttgaggcagtctgtgtttgcatctgtatgtatgtgtgtgttctgcatgttctgtgtatgtgagcataggtgccaggtggttcagcctttcctccctgctgccaggaggcatgggggtcagcaaccccaggctcttcctgaagcttccacatacctgtgctgcagcccgcacctcacgctttcctctttcttgggtctcagcaccccacctgaggcagtggttctggaggcagacacgttccccgggcatgcagcaggccgtgggacagacaccactgaaggagcagagtgaaattagggctgctctattggtatcccccagtcacaaagaagtagacacttttccaaatgttcgatttaggcctttaagttatggtaccaacccttctttcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcctaccactg

SEQ ID NO: 321 - DNA, 81788 bp, Homo sapiens
accagaaaaaactgaatgtgtgatttattatgtttaagattggtttataaggcttaaatatatctgtcatagttaacagttaacagcaaataaaggcaactttacaaaatcagtgtttccatacagtacaggactaaatgtggcaactgtgcattggaaaattaatatttcctcaatgcaaatatcaaatctgcagcaccatttagaagcttccactaaaaactcaagctgcagtatttattacaagctctactcagaacacaaggctacctaaatcaagcattagagaaaaacagtggagtcattcaggcataatatgtcagatttggtacaggattaaaatactaacatttttaatgtcctggtttcaaattaataaatacaaaaacaatataaaaatatacaaccagttgataagactgtactgcagatgctcagaaagttaaatctcgctctcatatgtatgcaggtatgtcttgagtgtcaggatttctgggtagctgcggctggtctttcggaagaagtccaggctggtgagatgttcaatgtcacgcaccctagctgtgtgcatcttcatgagttcttctacccattttgattcgtcctctgagctctgcaatggaaacagaacaaaatcagaatcagaattttccagaggagtttctccaaatggtcagtttactccaagtccacaaatgacctctgtgcactcttgcacacagagccaacgcatgttgatccttcctggcctccctgccactctaccgcattcctatgggtaatgtgccacaaatacctgcccttggctgtaaacattttcaacagcaattaactgtaccaaataaacgagacatgtggtgtcagagggcatttgactcaataggttctcagaacataaatcaaaattaggaaaaccaaaggccctagagaattcagtaatttgtttcttttccaagctgtcaaattgcaatattgagcacagagtacaagtaacttggaatatgcttctgcttcccaaggaaagtgaagaacttaagcctaatgcacgaaatgatgtgtgtgcattcctagtttttcaaaagaaactgctgcatcaaccacgtcatctactagaatgcataaattgctatttgaaaaatgaggtcaactcgaaaccactcagttgacacatctggcactctagggcccaacaggccagagttggaaatgaggctgtactacttcttggctatgagaccttggtcaagctacttgacttttgaggcctcagtttcttccttggttcacaaggataataatgcttacttctgcagctccctgggaggttagggaggagaggagggaagaagcggggggaaaggtaaagcaaggaaacacggaaaaaagaaagtgaatctctgcctcagctgcttgccaaaaattgccccactgacacaagttgcagatgaaagacattcagatgtcctgcatcaaacaacttatttcatgtctaacttgaaactaaaaggtaattcaggggaagcagttctttgcatctcaaaaatagcttctttcatttttgtgggaagttgagggaaagagtgagatctgagagccctgtgaatatggagcagtgtctactttcattagtagacattgagcaggacctttgcaagtaattccattcacaaatgcctctggaattgcaatggcttccaagagcccttctacaagttgaagggtggctgcatgtcctaggtctgggaatattcagacatgccctcatccaactctttaccaccagtggtctcagtgaactatccaccaaagcccaagaacctgcaatgggctttctcggaaagctccaacccacacaaacctggacagggaactgcagcagcttgtgccagtgctaaatatgttcgggagggtgttggttcaggaaactgatgcctggccatctcaggcaaaatgaagaaaggggaagaaattgctttgcaggctggggaggtaagaattttaaccttcatgtcccaccctcctaacccaacctaaccaagatctctgcgattcacaggaaaggaaagacctaaatataactctacccacaatggtactgaccagtcctcagtgtgaccctataattaacgaagtaggaggtctccagatgggtcaggaccccctcagagtaagcagggcaagcatgagcctgtattttgagagaattttcatattcagctcatttgtttgatttttcagtggtcagtcagtccaatttttttctttgtaaatgcagtcattttgaatgtgtggacaggggtgaaaaggtttttcctaatttaaatgatggctagctgggattataagaattctgcaaaaacatctgtcttttgctatttctttccttgggaagtgatttgccaatttcattggagaggcagtctcttccggttctcacactctgaaatctgttctataattcatcattaggaaatactagctatgtggcatgtgaaggaaatatcttctgccttgatgttcgctggcaatccacagaagcattcgctgatgaagactgtgctgcaagatgcaaaactaagacaattcagataaaagttcatgaacagcaaggtagggaggacaggaaagactttaaaaataaagcacttagaatattaatgcaaacaaaagcacaatccatgaacttgcttgctgtcttcctcattatggacattgattcttcacctgtcttttctccctgactttctccccaggtttgtgaattcaagtcccagaagttttaaggtaaaattcacagcaaggacagcttctacatgaacaggtgacccttcaacgagaagcatgctggccacgaactctacaagaagtgcctccagactctgtgcagagtcaggaaccagtagggagaggaaaacctgtaaggacttcagtggatttcatttatcagatataaaatttagatcgattacagaacagcctttgtaccaagtttagagcagtatttttaaaactccccatcaccaaattcctctaatgaccgaacttgaacatctattccccaggaatctaggtacaccttaaatggcctactatgtatatgaaatacctttgtagtcttttcatcttagaactgtatggcaatttttatttttatcccataatacaacagtttaatgttttgcaagaatttcacctccctacaagtttctaataagactgaagctcagagaacgtataccatgttatacggaggcattacatccacctggggcttttgtggttgtaaacaaccaaaattgagagggccaagccagtaagttgataacagcttgtctctcacttgcagtttccacatttctctaccacccattcccatcatttataaaaccctatggatccttcaagtataatattgttgtcttccatccttccttttagatctccaagaccacaaccccagttcaagttctctcttgcctcactcctgtgaatcttgcctaagccctttgagcacaatgttcagtctcctccatttcaaatttatcttcctaaagcagagccaaaaacgttgctcttccaactaaacattttccttgggtacctaatgcctaaaacgtacgaaaaaattcctaaattcccaaggttctactatggaagtctgataaattggaaagaggatgggctcttggagtcagaggccttaaatctaaagctctgctcttctgctgactaaccaagtaaccacacaacatactttccccttagtagctataaatttctcaacagttaacaaaaaggcaggggagagatcatatatatatatatttgcctcatactgtggttatatgattagaaataatatatgtagaggacctacacataatcggatcacaacatgtactcaataaatggtaacaactactactactgctcctgctatgatatctactatagctactattactactactactttttaaaaatttgattccaatcaacttttaaaatcttttctcccactatttgccctcatttctaatattctggcaaaacttaattcactttctgggatatatttaaactttctaattttcttctacattcatagcctcaatcttcacccataattgaagtcaacagatcaaaaactatcttgcccacaaagctgatcatctctattgaagctattcttgtggctccttgcctttcagtgttgcaatttccatacctgttttatttgttgacccactctgtgggctgcctaggaatagtgactctgtctaacacactcttgtttctcctagagtagcttatacaacttaggaatttgagtagtacttgttgactaaagattatcttctgtagattacatctctactccttctgtcatgtgaaacaaaagcatagaccattacttctaaaatcaacctttgagcacaaactttccatcaaattaaaaggacctgaaggtttttccatctgtccctgagtgtcaagttagtacagggccaggagcatatagcatggctcctgtcttcctccctagtgttttcatgatgccatcctgcatcctagctgtctccccacaggatgagtgaatcaggagtcatctgtgctatctgagaaaacagtgactgctacacctccatcataactagtagcaaacctgattagtaaggtatagatttctttctcgcttgctcttgctttgtgtgtgtgtgtgtgtgtgtgtgtgtttgtgtgtgtgtgtgtatgtgtgtgtattaaaaagttttcatggctgggtgcagtggctcacgcctgtaatcccagcactttgggaggccaaggtgggtggatcacgaggtcaggagattgagaccatcctggctaacacggtggaaccctgtctctactaaaaatacaaaaattagctgtgcgtggtggtgggcgcctatagtcccagctactcgggaggctgaggcaggagaatggcgtgagcccgggaggcggagcttgcagtgagccaagatcacaccactgcactccagcctaggtgacagagtgagactccgcctcaaaaaaaaaaaagttttcattatgggccacgcacaatggctcatgcctataatcccagcactttgggaagccaaggcaggtggatcacttgaggtcaggagttcaagaccagcctgaccaacatggtgaaaccccatctctactaaaaatacaaaaattagctgggcatggtggtgcccgcctacaatcccagctactcgggaggctgaggcaggagaatcacttgaatgcaggaggtgaaggttgcagtgagccaagatcaaaccactgcactccagcctgggcgacagagctaaaaaagaaaaaagttttttaatatggaaatttttaaacatccagaaaagtgaagtgagaaataaaattccatgacctcttaccaagcttcaacaattatcaaaattttgctagttcctacttttttataaaattttgtcattctccactttcttttgcaaaatgaaaaacatttggacatttatttctcaaaattgtacacattgatagaattatgttaaatgcacacatatattgaaaaataaagagtcattagaaggcaaaattcctacatgttaagcaaagttctgtttggttcctttcttttttctgtttagggtgaatgctttataataagtatgttctagttcaatgatggaaatataaagtaagaaacgaaggtgaactatggaagcaaatcctaaaggactctctctgtaaactcacattgcagctctcctcgttgtcaggccggtgaggcaggatgaaggaggacacagagagagggccgtcacacttgtcggcaggctgagtgaaatccagacagctggtgatgatgctgtagtagtgagttggaacaggaatggaactgccttccacgtacctgaaacaggaaggtaaaacgaagtcacagttgatgagttgatgttgaagctttcttttttaaatggtgatcaatgaatattgcctaagtcactaaaattaatccccattcaattgaatcatttttcacttctaagcactagcccacttctatgtctttgaaaataatgttttctttgcctggaatcccctcactcctcaacctggcagagtaagaaagatattccaggcaaagaaaatggattgatctaagaattggagacaggtaatggtgaatagaccaatgcagtagaaatgaaaggctggaagcgtcaataaaagccaaattatggtgggttctgagtgccaggatatggactggggcattattatttaggtagtaatgctccattaaaggtttttgtgctagggagtgtcattcattattagttccatgtttcaggaagataactttcctagagttgtataaaatggacaggggcaagagacattagagccaggagaataatgaccctttcaagctacaatgagatgcagaacttgatacaaagaactcatttgccaaaggaagtactaaggaccgagtgctaatgatggacctagaggtataaaaaatattttcctgtagagatcagtacagaaattcataattccttgcctggttttctattatcttaattttattcattttccaaatattaaaattacgatttaactactaatttaattttggctaacagtgatcagcaataaaataaatgtgcaatttacacaaaatttctcttcagaatgactggaaaagaagtaagataatttctatcttatttatctgtatttataaaatagcaatttattctgtaattatctctaaatcacaattaaaccctcttatactctgggctgctgattgtttcatgcttgtataaaattaaataacaacattctgaatttgtcaacaaatttgttgacaaattcagaatgttgttatttaattttatacaatgaaaatacatcccaatcactctaaatcttgctttctccactagactgtggggtcccttatgagcacagataatggcttttatatgcccaacagcaccaaagagacagagacaaccagattcaatccaagtccataggcactttgctactgagaggtactgactcagaaaatctaagggattcttaagtcccacccaaataatgaagataagtgggaatggtcatcttcccattgaagagctgttgaagaaatgactaaacaaaattaaatcctttaatacatttttttcatagaataaaaaagtgcatttatttaccacaaaacccaaaattccattcccaccaccaatgcccatttaatcaaaagaattgataaattcaggctgggcacagtggctcacacctggaatcccagaactttgggaggccgaggagggtagaacacttgaggtcaggagttcaagaccagcctggccaacatggtgaaaccccgtctctgctaaaaatacaaaaattagctggatgtggtggtgcatgcctgtaatcccagttactcaggaggctgaagcaggagaatcacttgaacccaggaggcggaggttgcagtgagccgagatcacatcactgcagtccagcctgggcaacagagcaagacgccgtctcaaaaaaatatatatatatatatattgaaaaattcaaaaaacttaaggggtgtcatctcttctctagtatatgaatatttgaaaaacttcttgagtgagatcttgggacttaaaaatcacacactgagtagaaatgaaacgcttactgttttattttgtcttctgtgtcatgtaagccatcatagtcatagtcgaagattggtccacttatcacgttaactccatttctttccgaagcatatttcttcaccaataccctttggaaataattccagacccctgtgcaaagacaaaaatccaaaaatcaattattcatgaagaaaactccttactctagccaaattctctctaggatgcatgctacgagccaaatctcacaagccaagagacaagagagctgtcgtgattcatgagatgaatcaattctatggcattaccagtgtgtgtgtcatttacaaaccagcaaagggaacagtgtagagctatgaaacaatggtaggggagtttaacgtagttcaaaagtcaggaaaggatcctcccaagctgagatctgaagcatggataagtaggtggtgtttcccaggcagaacacgccaggcagagggaacagaatgtgcaaaagaggaagtatggtgtttcagagtaatgaaaataaggccttactctttcttctcgtccttcatatctcatcaatatgctagttcccaggtttaagctttacccctgacctttcctggagatccagacatgttatccaaccacctacctcctaatgcactggaatacctaatattcatgtcaagcaaaagaattttaatgttccttcctaatcctgccccaaccctcgccttctccatcataatcaatggctctggcactcacccaggtgtttgggccaaaagcctaagagtcatccttgctttctctcctagctatagacacatgtgaacaattcctgtcagtgctatcaccaaagtacatcccaattatcccaaatttgaccacctctcatcttttcactgctctatcctggtctaacttaccatcctctctgagtgagctatcacaccacaaaagactattccctgggttccctgtgaaatgcttacttcccttgtaccttgtagcccactcccccatatcgtagccagacggagccttttacaccataagtcagactgtatctttctcttgcacgcacatgcacacacacacacacaccacccatttccaacactccagattatttttcattgtaattagagtgaaatcccaactccccaccatggtctttgcctacctctgtgactttacttcctacccctttccctatcactcgcaagactttcttcctgtcccctgacttttcccctaacttatttcaggctaagcttttgcacttgctctttccttcgtttgaaaaacattcctggatctgtgcatgtctgctttctcctctataattctttctcactttcactgtcatcccctgcagagaactgccttatcctcctgcttctaatttccataatggccaaccagaggggcagaatggaaatggagaaaaacaagagaataacagaaggagacaggataggcaagcaatgggttggttctgaaatattagatcgaattcgccatgctgtcttcaacatgggtgtcatgcggttctggctgttaacccctcttccctccccttattaaaaagcacctggccatgcttctcatactgcttcaattgctcttcctgccttctgaaactctgaatggcagagcagcccacaagagccaaaataccttagataattatttgcagtcaagaaagaagccagacagtaagaaaggagttcaaacgttaacttaagcattaagaaaaaatggagaggaagagaaggaaagaaacaatgagaacagtcaaaaggccaggcctgcagaaatgtggcatgtgaaaaaaccacccccctcgtggagaacagcaagctctctatgaaaggccttctccacaccagcctcagggtggtactgtgtgttgccttgattaccatttggtcaaaaaaacacatcaataaagaataaagaaatccagagaaccctgatttgcagaaattaaatgaagctgcattctatgtaatattgtgataaatgtaactatgtgagtttctgaaatgcttctcagttgggtctgagaacaaaccaagaaatctttttaaaagcatactttaatttttcactcataagcaataaattctctttgaataaaccttcgtttactaactaggacatcaaataaacatttttttctctaaaccgtgtggcccttttcaccaatgttaagctgcggaggcccgccactgtagctgacactccacaatcgcccattcctattttgagactccctttcagccctgagagttacataacacagcctgaacctcctccatcaagttgaagcacatagaggtgcttccttttcctacctttcccataacgatttaagttctgttcactacaaatgtactgaaaggtggtaaaagctacttcataatgcttactctatctttgaacacatggatagataaaaggatggatgggtggacagggggatggatggatgaatgaggatggagacatagatgaatagttaacagaaacaaaaaatgcagtgctttcgacattggataattaagtcagaaatccatataaaccttagaggtcatgcaatcatatctcttaatttcacaaatgagagatttaatgacatttctatgatcacacagcctgtggtcacactccaggaacttggctttttgtgcccgagctcattgtgcctatacaattcttgacttcaccagcatccacaaatatttatgtcaggtacaaagaaattacaaatgttcaaagaaactaaaataattggtacaggactaaaatcatctgaaataaacactctgatgattcagaaggtcctttcggctcttgctgggtttcagggccaacattcagaaaatgttatcaccccaagaggaagaggtgctactggcttttactgcaatgctcaacaaataaatatagatgctgttaaatatcaagtggctttcaaaatatagtgaagaccctttttaaccattaagataataagtattgaaataaaaataacaaccatattagaagaaaaacacaaacttgggttagttcagtttctaccatgcatgacctgtggtcactttctgtgatatcaatttcttaattataaaccggggataaactaccagccaaccttcctcacagattcaaattttggatcaatgtagaaagtttacatgaaatcaaagtttacatcaatgtagaaagtttacatgaaagatcctcaaaaattataaaggttaaacacatgaaaagtattcttattaaaattaacagaggtagaaaaggtaaggggtaaatttagaaatgtttattttcataaataacagtgtattaggtaaatattggacttacgtttgaaagcaggatacattggaaccatattggttacaaggaatgcatcatatttagcctctggtgaagagctcagatctaaacattaggaaaacaaatagtatacgttgcttaccaaaatctatatcagttaaaaaaaaaagggagaggggggtagaattttcttaaatggtccaaacaacatgaagtaaatgaatctactcttttattcctactcctaactgcgttatacaacatgtccttactcccctcccactcagtctcttcttcactcaatagctctctcccaagagccatttacaatgtttttttcttactgtctacttcttgagtctaccaacattatgtaaaataactccttgatttcatcagtgccatttagacttaaaaaaaaatcatcaaggtaatgagagatggtttaagggcttcagatttttttttttaaatatggaatcttgctctgtcacccagggtgaagtgcagtggcctgatcacagcccactgtagcctcaatctcccagatttaagggatcctcccacctcagcctccagagtatcagggactactggcgtgtgccaccagctcagctaattttttaatttttttagagacaaggtcttgctatgttgtccaggctcatctcgaactcctggactcaagcaaccctcccatcttggcctcccaaagtgctggaattactttgggattacaatggtggctcatgcctggcctcaagcaatcttaagagatcccctctatagtattacataaacgactagtgtcttaatgattcactgtttccttttcagattctcatttaataatgtaaggcgggacacagaagattcccttgcacattagaattcccctggagaattagatttttttgaaagctagtcactttttggctgattttggaaggatcccataaaaattcatttagataatcttctgagcaccctctcttgaagaaaacccaagccactgaaattccaaataccaagattgcacaatgtgacatccctctgaaggcatcagatcttgatattcttaacttacaaggaggaaagaggaatccgtaggacatctgcttatcatttttgtaggccaaacagttctgactgaaactcggagaaacacggacatcaggccggacgcaactggtcagatggtcaggaacgctggaaacctcagcctgcacgggagtcagaggcactcagcaatgccgtggctctgttacgaacggctgaaatcaaaacccctctggcttctcctatgcttgtattctgattgatagtctgactccttttttaaattttttatctttgatagtctgacttctttttaaaagtccttagttttaagtacagtaagccacaagttttcaaactttttttaatcaacataactctctttatcaaagtcttaagaaaaacaatatagaaagcagaacataaagcagaaatcccactgttgaaataataaatagaatctcattgaagataacttataaaataacactcttacaaacaatatagatgtatctcctctaaatagactatttatctgtgtgtgtgtgtgtgtgtgtgtgtgtgtgtgtagaatgtacaagaacatacgtatgtgtacacagtacaaatcaaaataaactgtatttggggcagtagaagtgttctcctcctttgtattaaaaaattttaaacatgcctcaactgccaaataacattttctaatttgtgatatatacctatttatctcatcttcatcaaaactgaaacccccaacataaaacttttgttaaaaaacaacagggccaggcgtggtggctcatgcctgtaatcccagcactttgggaggccgaggcaggcagatcacctgaggtcaggagttcgagaccagcctgaccaacatggcaaaactccatctctactaaaaatacaaaaattagccaggtgtggtggcgtgcatctctaattccagctactcgggaggctgaggcaggagaatcacttgaacccaggaggcagaggttgcagtgagctgagatcatgccactgcactccagcctgggagacagagcaagactcggtctcaaaacattagaaaaaaaaaaaaaacagatgctgatagtgggggaggttgaaggggggtgggtgagtatgtgggaactctgcactttacactcaatcttgctgagaaataaaatgtgctcttaaaatataaagtctattaaaataaataaacaaaccttggcagtttctgtaactattgggcaatgacttaggcagagtaaaagaaaataaaagaattagtgatctaccttcaaagtttaacatattcccatggaattaccagaacattgaataaaggctaattcaaaatatcttacaataaatccaacataggatttctgtcattaagaaaaaataaaatattttctaagacaaaattctgttaagcaaggaatcattgtattaacatgaggaatgtaataaaataaaaaatataaaatccaattttctcaatgacctgtttggaaacagtatatgatgtccagagtggcattaggaatatttcactataaccactttcaaagtcagtgtgatataagatatcatatctagtccgataaagcactgcaggtcgcccatagaggaggtgtctctctaaaaaagaaaaaaaataaactgtgttaggtgcatattaaattttacatcaaatgttaaagaaatgttggaagagtcaagttacctaaaatggctagcttacttattattaatatagcaccttctccttaatttaatcaagctagttttcctaacacttttgtggttgatctgatcacctaaccatgggtcaagctttacagttatcaaaaccataatgtaaatgctgtatttacagaatgctttttttagttgtaaagaatttacaatttgtatataaaggaaacattatgtaataaattttgaaatgattcagctgaatggaaagccaataggattggatttctgtagaattaattattttgacccctgaagaggcttatcaggtacaccaatgatttaattaagaagaaggcacacattgatcattatatgcatacagcaactcaaatatgcattccttcagcataaaaagtgagtagtaatgagcatttaaagtaagcagctttgtcatacagaggaaaagtctttaggtaagaacttaaaggaacatgtatagataaaataagtgggcattcaagagggtcttctaagtacagaagagggaagttcatcagttaccaaagaactcaatgaagacccccagtgcagattcagacctccaaaggaaagctctcttcttaggaaaaaaaaaggtctgaagctttactctttgcggaagaagagatgggagttcagtatgaaaatcttcattccacactctgcaataaatacctggagcttgatctgcccactttggataggctaaagtcaaaacttccacagattcttggaaatgtggggccctacagaccaaaatatttagagactgaggcttaggcaattcacaattccttaagtgataaatttaaaaaaaaataaattcttgtactattttttctactagagaaaatcagttctgaaaaacacttattaaataatgtatacatgttgctttaattaaagtcttaccattctatgcaagtaatggagaaaagtcttcgtagaatactttgcaagaccctcccagatagaactgcggatttgagacaaagcggcccacactattacaacacaagcctgttctgggtagttcggctgctccagcattgcagtaaatgtagaagccttagttaagctgccaaatttggggacccacccctaaggattagaacataatctgacaatattaaataaatgaaatataataaacaaataaaacaccagcaaatcgtaacagtagtacttaggggcagtaaaacaacccagactttccttcaaaactcaaaccaaaccttttctaggttcaaaatttccattaatgttttccttgttttcatttctgctgcctctgaatttcctggtttcagctggaagcagaagtatcaaaattctttgagaagctattctcttttcatcatttaagttttcatggttaccacacacagtcctccaaactcaaattcaagcttggcatctaatcgattccattaggggacaataaaatagcagccatgttcccatacgcaatacccctccctagagcaaccaccaaacaaaaatcttggacaatctatagtctctactaactctggctcttcctctaaatcctcctcatttctaagcattcaacgtaacactctattccacaaaggctaatgtatttgcaacactctcttcacaattgttgttagcaacattacactatcatatatgctatttcctttctctctaccagaaataacttctccagtcttcgccaagtctgtcacctatctccttccaaatgtatccattattcttcatcatcaaacattgagcgccttggttgtgccagaccttgcgctgtagaatggaggtactgggcaaagatgattaagatagagctcttaccctcaaagagctcacaagtcaaagggagagacaaacatagcacaaataacagatgccatgtggtctgcaccatattaaagatagttacagagtgtgatgggaatgcagaggatgatgaatactggaaatggagtgaaggtggcatcaataaagtcctttaaggagcatatgaagttaaaccaggctggccccatgttacagttttatgcctgttgccctggtataattgttaatagtgtcccttttcacgctcaaaagtgtatgacaaatattcagccctcatggaagagacatgaagaagaaagggcgaggggcccaagaggggcagagatatcttaagattcattttctctgccgggcatggtggatcatgcctggaatcacaacactttgggaggcaaaggcgggtggattgcttaaggtcaggagttcaagactagctggccaacatggcaaaaccctgtctctactaaaaatacaaaaattaaccaggcacggtggtgcgcacctgtaatcccagctactagggagtctgagacaggagaatcgcttgaacccaggatgtggaggatgcagttagccaaggtcatgccactgcactccagcctaggtgacagagcgaggctccgtctcttaaaaaaaaaaaaaaaaaagattcattttctcctgaaaggtttcctcaataaagcttctccatctctactcactctactgctctacatatatagattcaacttgcttcagaaatttgggttctggccaggcatagtggctcacgcctgtaagcctagcactttgggaggctgaggtgggcagatcacttgaggtcaggagtttgagccagcctggccaacatggtgaaaccccatctctactgaaaatacaaaaattagccaggcatggtagcacacgcctgtaatcccagctacttgggaggctggggcagaactgcttgaacctgggaggcagaggatgcagtgagccaagatcgtgcgactgcactccagcctgggcaacagtgcaagactctgtctcagaaaaaaaagaaaagaaaagaaagaaatttgagttccatagcttccaagctattgtcataactgcaagttttggcacacagctggaacacaaaagtatcactgactgcctttttctcaattattactgagcaaaaatagcataataaggggaaaaaatacagtggtttttacagcctcctaaaaatccaaccaaggtccccaatgacccaaaaaaatctacttgggtcttcctggagcttaacagtttcatctaagaaagagggggaaataatctctgcagtaagaaacacagattttaaggtccagaatcaaaatttagattttattttttcagtttatcaaagtatcaaagaatcacagattcagagtcatagcctgactctcctagtctttatgacatcttgggggagccacccactgcatttttgttgagcaaaaagtctctctactcaggccacaaaatgtacttgaatcttgttctcggcacacattgagatctttatctcgagaccagcaaccctggagactagcctgcaagcctctgcttctgcaatatgtttctgggatttcttcacgtggatctagtataacctggtcttcccaggctgagaatgcctgtcatggaattccagaccgagccttcattccacaccccagttccctgtttacaatagtgtctctggcagttttggtacatgccaaggttctcctccagataccacacttggcaaaatactgtgaggccaatctttttaagtggtgtggacttccccagcactcattctttttgtattccaaatttgggtcgtagagactggagtttgtgttccttttccctcctcagcttcctgattcagattcccacagatgagcaggctgtcttgagagccacatgaaaatctctcctcttttttgtttttttaaaacatacactcccacaataatatgctcttaaatcttaccacaaaatctctacccaagatctttccttttcttgcatactttctcctttgccttacaagtgcctattatcatttgctgccatttcaacctcctctgagatttgatttaaggcctctctttagtgccctgttctttcttaccccaaccttgaaaacattatgctgtaatgtatcaactggataaatcctacaacagaacaataactttatgaggacaaggacttcatctgttttactcaccactgtatcttccatctccaacaatgcccatcacataatatctacttggcaaacacttgttggtaagttaatgatacatattttttttaaatcttggctttctacatatgacctgtctaatgttaccctgaaaggtacactgggcaggtcagtagtatcatctccaacttactgatgaaggaactggaggtttatgatttgcacaaaataattcagctgcatagcagcactagaatcccaggccattactcttctgcttggccttttgggtggtctccagttgggtgctggccgctgggttatttcatggagagtgtatgggaaagaagatccaactacttcccggcaggaactctgcccgagtaatgcctactgagaagctaatgaggacagtagtttctgtcaaagcatctagtatttcagaagcaacttccaaactttgatatacaaattttttgttgagcaaagagtctctctacttaggccacaaaatgtatatgaaaagcaaaattttcttttgacatattccctttgttcccactcttagaataagaagcattttcagatgaaagcacatgggcttcagtgtcatataaaactgcgttcaaatctaatctcagctctttatagttgtggtactctgtaacttaatctcccaaagctttatatctccctggaatgttgcactgtttacaggcaaaatatgtgaagtggcttgtttagttttaacccaaagtaactgcagttgtagcagttgcagttgtactgtttagtaaaggtatgggctctacctcaatactggcaaagaatattgctaggtaaaagttgttaaaattcaatctaccatcaaattcatcttgaattctactataaacaataaacaattactatgtattgatttcttccaagtattcccaaaaacacacagatacacacgcagacacaaacactcagaagcaggagtgaatgctatctccttctttctctagaacaactaatatctccaaagaaataacacaaatgagaaacattccagaattgacaagagctaaagaagatgttccctctgtagccatattcaggactctgctttaaagttaacaagaattactagtgtttaagtcaattttctttttcttttttgaaacagagtttcactcttgttgcccaggctggagtacaatggcgagatctcgactcactgcacctccacctcctgggttcaagcgattctcctgccccagtctccctagtagctgggattacaggtggatgccacgatgcccagctaatttttgtattcttagtagagatggggtttcaccatgttggtcaggctggttttgaactcttgacctcaggtgatccacccacctcggcctcccaaagtcctgggattacaagtgtgagccactgaccgcacccagctgtgtttaagtcattttcctatccaaactaacttctcattgtgtatgataaggagccaagtatacataggtgttaaaattatttttaattcctttttcacaaagatgatggtgagggctaacctaagaaaatatgaaacatttttatagcaatgtaaatagagtaaagaccaaggtgaaaataaatggtgcaattattcttgcagtgaaaattatacttggctatagtgccagaattgcttgctacaagagattttttaaattttcttttcattcattaattcatccatcaattcaatgccacaaggaaatgagttttcattgcatggaaagtcggccaagacattaggtatatgagatccagaaataacaacaggcatgcaattaagacctggagtctaccacctatctagaaatattaaagtttagcaagcagcttagatggccatttttgaggattacatttttctttctctttattttagtaaaggatttgattccataacagtttaaatatttatagcaaaatattgcccaagattggtttaacatacctcttttttatcacagatatccctgtgatcgtttcactattggaacatgcagcttttactcatgtattttgtacagatgtatgacagattttacagcatatgccattaaaacagtcacatataaatgttacaggtgaagtgtgtatagctcatgacatattctgaaaaatatcaactacttacatctgtgttttaaaaaactaataataaaaatagtacaactttacatctgtatagaagtttaggtttacaaactactttaaaagccttcatatgtattcaaaggtacctagaaaggggaagtaattgccctgaacataatacatgtgtgctcacatacatggtggttcacattcacaaggatctcctccagtagggcagacactgaatattttaaatgggaggccaaatttatgacacaggaaacaccataaaggcctgaaagaactcagaccaagaaaacatcgctttgccactgaagaaatgaccaagatagagcccaaaaggaaacaaagcccaagagacagcgataggagagagcaacaggagaaagagcattgaggtttatacatattccagcatctaagcaaggaaatgcattgcacataataagacaaatatttttgaaggctctcttgtgtcattaaatgttggtgccactaggccatgagcagacttagaatagcatgagctattctagattcccccctaatattttatgccaccactttgaagccatgaattagaaactctcagtggtacagttgtgtcagagtaaccagtgccagcccagtgtcagtattcaacaaatgcttgctgaatgtatccatgagggtttgtttccatgaaaatacacaaactttaagcttcagcggtataaaaagacacttcagggatttaagtaagaaactcacgttccactcagagcagagcaatggagatgtaaccttactaactatagctccttatagccctgagagtcagtgattcactaagaagatgtgtcttatttttatgctcttaagtttgaggtgattgtgtgtgtttttttgttgttgttgttgtttgtttgtttgtgagacagtctcgctctgtcgcccaggttgcagtgcagtggtgcgatctcagctcactgcaacctctgcctcccaggttcaaacaattctcctgcctcagtctcccacgtagctgggattacaggcacgcgccactgccgcccggctaatttttgtatttttttagtagagaaggggtttcaccatgttagccaggctggtctcaaactcctgacctcaggtaatccacctgcctcagcctcctagagtgctgggattacaggcatgagccactgtgcccggctgaggttattgtttataatgaattgtgagactggttttgtcatataaggacactgccaccaacaaattaaatgcaggaatgtttttctcagacagaaatgctttagtaccatgaacagtcagactttgaatcagcaaaatcatgggagttcaatagaagttaccataattaatttcattagtgacttttagaagagaagcatctgagtagtatttatctgccttggcaactaaatatctaaaaaacttgaatcatgagactccccatcttttgactctagcaatgttctaattgttctaattataatgacactatagtccactagaggttaggtgtcgaacattgcaaatcacttgtagagtttgtgaaagatttgtgtgccttctaccaacaatggcctatcttcaaagtgagattcattccgttctgtgccagagtctgtgtgttctgtgatcaaagggagaagtgggatgatggagatacagaaaaggaagaaggaggcagatgaagatctttaaaagaggaaaaataagtcaagtaaatcaaatcttctaccggtttcctcaactctacttaatcagattggaaagagcatatatgataaacagaaccatatgtaagctaataactcaagcgatgctctcaggagaatttgaccacgtgcatctttgctgcatgacttgtggctgctatgcttgaattctttctgcattttccatacacttttagtcatttcctggctgtttcaacatgttatcccatctactttagtaacatgtataggaggcttcccctccccttctattttcctccaattttgtgaaacttcacaatcagataaaaagagcctgcatggtagattgtgttattgctcctcattatttactgcctccacccattgccatatgacttgcaggatagagtccccgtggaaaaaatgtacttccctacaccattggtatcatgtgctcagctttggccagcaaactgtgaatggagtgacatatgcctcataaaagcagaagcattaagacacagtgcacagttctgccactcttttccctctgtcaagagcaggacatgtctctgatgaaggctactccttcagcctgggttccagaataaagaatacacatggagcaaagctgcccttggcctacagccagcacactaaaatgggagcgagaaacgcctcttagtacaaatcactaatttttttttttttggtcatatcataagcttgcgaaagttcactaatacgtgctcgttatcattgtacgtaaagtaagagttagggcttgagatgatccttcatatgaggagggagttctgatttgattccttcggtgaatctctccctatcacaatatatatatatctatatatacactgactctcgaggtagataccttcaggataggcaccagctgctattatttatcattgtgactatcattccctttataggagtgccccacagtgtcttatgactcatcagatacaaaatggattgtgtacttttcagagggcttaaaagctattgaggggggagaaaagctattggaatttttttattacacagctggcatcttgtgtacatggaataaacaaatatcctttgccagataggtatgaaagtcactttgaaatacaaattctaattttaaacaatattgtgcttacactataatgtaaataagaagccttttcgattttcgaaaacgagaaaaaccttatctgattattttgcaaccaccccttaccttctgtagacccttttgtatgaagccgtttgttgagttcatccaacttgttcttcatgtgtgaaaaccagtaaaggaaaaaagaaagcaaatcagaaatgttctttccctctgtgcccttctgtcgacttagcaccctgctaaattcaaaagcgaactctaaactccatctatatcatacattctttcgaggaattaactgttttctctcaaactgacattctgggctccacctctagcagttctatgtttgtaagcaccttcttcaatctctgtttccttccttaaaactgtggatagtcaccacagtaccaatttcccatgtgggtactgatgatgacttgggcatatatgtgtaagtaaattaggatagcgcctaaatgtttcagattaatctctaggcacactgaagtgattcccaaactaatttatgaaatcacttttcaccaaagctaaaacgtaatgactcagcaattctgaaacagcatgagtcagcaactctacccttcactgtataccctagcatatgcgtgcaagaagacatttccagtaatgtctgtggcaacattgttgtaagagctaacatttgcaaattactaaatgttctcaagtaggaaaatggaaaaaaattcttatggtacatttatacaattaaatattaactactgtattagcagtaaaaataagtgagctaaaacttcatgtactaatatacattaagtctcaaaaacataatgataaaataattgcaggatacatatagtataatagcatttattaaaaattttacaacatgcaaaactatagtataggttattttaggaaactatacaaaagattacttcatacgttatttaataaatatataaggccaggcacagtggctcacgcctgtaatctcaacatattgggaggccaaggcgggtggatcagctgagtcaggagttgaagaccagcctggccaacatagtgaaaccccgtctctactaaaactacaaaaattatccaggcatggtggcaggagcctgtaatcccagctactcaggaggctgaggcaggagaataacttgaactcaggaggcagaggttgcagtaagccgagatcacactactgcactccagcctgggcaacagagcgagactccatctcaaaaaaaaaaaaaaaaaagaaaacctgtccaagcatagtgtgtgggggtagtctctgtttgcaccaccaccgcatccttgttgcaccctcccacaccctgctctgtggcctgggaggctgacctctagggatggcatcaaagagcaaacttgccctgtggctccctgttgggctctaccaaggggaaacatgtgaaaggaagtacaggggaggaagatgacggtagcactctcctatctgggagtgctccctgctgggttgcaatgaacaagctgcactcatcggccaaatacaatagttccttcctattcggttgtctctccatgttttggaaacttactccttcccctcaccctttaaaccttagaaggtactatgcgaaccccagggcacttcgtcactcctcattgaattccatccaccctgctcagccttggtaaattactcattaaacatgactgaaacaattcctttaaactctctctttttttcatttccttttttttttttttgagtcagagtctcactccgtcttccaggctggagtgtggtgacacaatcccggctcactgcaacctctgcctcaagcgattctcccacctcagcctcccagcgccaccatgcccggctaatttttttgtgtttttagtagagacagggtttcaccatgttgaccaagctggtctggaactcctgacctcaattcatccacccatctcagcctcccaaagtgctgggattataggcgtgagccaccatacctggcctaaactctctttcaaaacctcttctatatgggccacctgtctcccgtcgggaccatgactaatagacatgtgatccacagttgaagaaaacagaaaaagattttggttgagaactgtgactgcacagaatagcaacatgaattctactttttgtctttcatggtctatacctgtgctattcaatatggtagccacaagccacatagggctctttaattataaagtaatgaaataaaaatttgagttcctcagtcacactagccagtagctaccattttggacagcataattatagaccatgtccattgtcacagaaagttctatgggccagcactgttagccacccaacaaacttctccataataaacataaagattatttctacctttggctctaccttatcatcacaagtgcagcccaggtcaaaatcagactgaaggtacataatccctggataattgggtctggtaacttcctctggcatggttggcctgaaggtattagtgcgcaggagatgattcaaacttccatgggtcccattattaggagctggcttcaatcccaggagatctaatgaaaattaagaaaaggaggcaggtgcttcttatatttttttgatgagatatggtaagatttaaaacccttcaccttctatgggtctgaaaactgtgaacacaaatcagaactggacaaaaccaaatgtagatggcaggcaccccctccttacctcctgaaccattctggactaactacatcttgccacagctttctgaaatacccaagttcattgcctgaccatgaatagagagagagagattcccagaaagaaagagtgaaggaacaagactttgattaactattgcctgtatctgcgatagttacaacccaagggtgatcaatgtcagtatcactttttcctgcacttctctgggactatttaattccatgttttgaaatgagacttataatcaataactaactagaagtctgccctctaatgactccacagaagtgtggggacatgaggaggctttggccctgtcccctgaagtgccactgagcaatgaacaggctgatttcatagcaagtgaatggttgccaagtgcgtattcagtaacttgcttgagctcagaggcaggacaggggacagctagcagccaagatgggaaaagaacccaggagacccgacttgcagactccccctctaaccaccagactggcactcccttactaaataggaaaagttgtcctcattcagcaactagaagttcaaggaagaaaaataattaagagcacataaatagctggccaggatgcaagctggcaacatttttaactgggctgcaatgcaagagatggaggtggaggggactctgtgcagaactcttgcttcatcaggtctctgaccagtggtgtcaaactgtaatgctatgttagaccagccagaggctgccaacagcaacactatgaaaacgccccattagtcaactgttgaaggaagacaaagaagccttagaaggggataatattctgtctttgaaccaatgggcaagttacaaccttttgtggggaagaggaggtagtcccagaaaatagacacctcatttctttctctgacattgagaaagatcatatatactaactaaagattgtttcaatggttctgattaaatgagtgacttaccacacataacattgtaaagttcaatgttttcaaatggaggcactttagtcttgtacttaaatgttgagccataacctacaaaaacagtcttccaaaagaaaagaaaaacaaaaacagttaagcattgttaggtaggaacccttcctctatttatgaatactgtacaacttcactcacaccaccattacttatcctttcgaagaaccactaaaacacaatttcaattcacagttctgccatcatacctgcatgctgttgaccttgttatcaaatccgtggtctccctggaaaaagcattttcctgatggtttcttataaacatccaaaggtttcctaaattgaaacaatttcatgattagttagaatttctcatgaaattactttgataaaaaggtaatttcagggtacaaagaatatctaagaaggggcttttgaaagtttgcctctattttaattgcattcttcttgtgatgatgaaaagaggatcctatgcatttctccaagtgacttttctttgacagttattgcaggataaatggcgacctgtgaactgaagtcacgatgccctccttggagctcgtgcttacaccaagtagggcacttgtcaaaagtcatgctctgcctgtctaggtgcttcgctagctctgagactgtaagattctcgactctaggaccatgtttgtctggttcacttctatgtacccctccctagggtcagtgtcaagacatagttggcactttaaaaaaatgtgatgtctcacctattatatacccataataatttaaaatttaaaataaaataaatttgcgatgtttaaacaatgaatggagatctatattctataaaaatatttgcatgcaaatttatctatcaatatacaatacaactagagtacaactaagcagccaacttaacagtaatcatgacatatctgacaaaagcatggtctcacctagacaatatctctatttagaaacagaaaacagaaatactgctctctagacatcaagaccatctgatctttccttttgtgacagaagacaccttttgcaaaagtgtcatgtgacccttttccaaaatagctttcatgttaatttaatacaaatatttcctaagtacctatgggtatatagcactgaaagtgctttgggaaaacaaaaaatctaacatacgggtctccacccttggaaaaataagggcttgggataataagacatatgcatacaatacctcaacaatgcaagatgagttaaatttaaaagatgcattgttaaccaacatgcctggttttgggctacactaatttgcccaactgtcatcatctttcacttaacttctactcagctcccatgtttttgccatatgaacctactacctgcgccagtgtgaccccttccaagctgccccatacataaaaggtccttcaggagcacataccgggccaattaatttcagtcacatcccaattaatttaccaggccagtaaattctccatgaggatttcccacaactgttttagaagactccaataattcctgttcttcgtacatctttcttcataatcccacatatctaactctaagtacaccctggaaaattacagcatgatatttatgtatctgtcaaatgtgtctctctaaacatcccatactgatacaagtttctagagttctaagttcttcttagaacttgagtttctaaatattttcttgttatcttctttctcttgcaaactagtacccagctagagtacatgtggcagttgttcaattattgagatagacaaattcacagcacttttcttaagtagaaagttggagcaagagtgagtgggaacagctacttccaggtctgtgtgaaaatggataaatccttaataattaactcattggaagttgttagagcctccagacatgtcctagaccacattcaaaagcaaggaacattctcttcaacattggagagtgttttgtagttcaatagaaggcaaacattgggaatatttaaagcaatgtaaaaagtgcccacaataacagagtttttaacattaacaacattttctaaagtcctctataaatattgctacaagcaaagtctcaacaaccgagatcaaatcagcccaatatactaaggcaagctcccatttatacttttgacttactcaagtagtaagaatagagtttagaatgtaaattcaaaggatgaaagagacacacacacacacacacacacacacacacacacagatgcactgacagactgcaaagagacaccacaatgctgagacccagaacatagagatatattgtctcagcactgatggtttatgtagcccacaaaatctttggaaacagtgagatttccaactgatatttctttcagtgatgactaaggatgataaaatatttccagttgccaaaggggtggttgtggaaatgagaaacagaaatagcccatataccagttaccttgcaacatgccatctgcgttccaccaataaatggatatcctcaattcttctgttgttggcatagtgcaaacgtttgggaaggtgctgtttcaagtaaggcttaaagtgctgatctggttttttacactgaaatagaaatggaaatcagacttcagatggaatgtcttttggaaaaattcttacaaattctctctctagaaagctgaaggagattttaagcctaaccaaaggttaatgagtgaataaatgaaatttatttctattaaataatgtatgctgaaaacaaatagattcaaaagagattaagtaaccttggagatgatatgacaggctatctgaggacagttaggaattttaagatgcattcctggcttgtgagaccatcgctaagagcaattcacactccaaggcctttcccaactccttcaagtcaagcagttgggggtggggtgtcggtgggaggggaggagcacatgggtttaggcttatctgattagatgctcttgtaccactaaggtcgctacccagcatccgggaacaatggagcagagtgggtgggcagttctggttcagggaaagtaaagatttgtttaaccatgaatgaatacttttcagttctaatggaaggatcagatattctccatttgtatcattgccaagaccattagggagcctgcagctgaccacaggccagaagttttgaaagttcttaaggaaacaaatatacaggatggcagggcagtgaggaaagtgttcctcccacccctccccgccgggggaggcacacacaggagggaggctgctccaggggcagaggcctgggcagggcagaggcgggacaactggaaacacttaccgtgagattggcaataatggctttggggtcatctgttcaaagagaggagaaagatttcaaaagaaataacaaccattaccaagagaaatcatttttgcagcaagatactcaattctttctccttccatcccacagaagactatcactttagtgttttgtttgaaagataaataattgtgtaggggtatttaacatttcagtcattgacatgcagctaagcaagtggaacaaatcctatagtaaactgccctcctaggtccagttctgctcttctggagggaattcctccttccatagcaccaggatactgctaggtaaattgcttcttgttttaagttccccctaatggttccccttgagacataatttatttgcagtttgacctcaggaactaaactgggcatttggggcttttaatgtaacttcttatttatctgcagatttttgaaacaagtcttcacccactttaagttgaaacttctaatccattgagttatttttttaaaagggagtttgtttccctatttatatcctgggtgtaattacacaggtagccgcacctctccagccatagacacacacgtgcatgcacctcctttattttcaatagcatcaagtaaaagattttagtcaatactctgaactagctaaaagcaaaattatgtaaatgatggctgtgcataaactgtggacaggattatattatctgaagctccccttttgggcggaatgtggggagaaagaggagattgtaggttgcttggattttgttttgttttcaggaagtttgcttcagtatgttattacagaatcagcagaaaaggaaagtggtgttcagaagagatagcaactatcatgaggcagccctccctggcatctaaataccagtggagcaggccttatctgtatcacgtgctgctgcatccctgggcctgttcagagtagacactcaatatacatttgttaataaatatttgttcatatttgttaaaaatgtatgaataaacttgccttgggatataaatatacagactccaaagtctattttcagaatcttagctctaaagcttgaaatccgaaactaaaatgtgtattccattggccttaattacatctcttactagaaggcaaataagtaataatgtaataataatagcccgaatagatttcatactatgtgcctgtctttctataagagctctgcaggtggccagatacagtgatgcctgtaatcccagcactttgagaggcaggggtgggtggatcacaagttcaggagatcgagaccatcctggctaacatggtgaaatcccgtctctactaaaaatacaaaaaattagccaggcttggtggcatgtgcctgtagtcccagctacttgggaagctgaggcaggagaattgcttgaacccaggaggcagaggttgcagtgagccaagatggagccactgcactccagcctgggcgacagaacaaaactccgcctcaaaaaaaaaaaaaaaaaaaaaaaagagctttgcaggcactttctctctggtcattcacaataaccctaggaggtaaatgctgttcaaatcctcactaagccaatgggttttcagaaggaggaggagttggcactctgacactcaagcaacctgattgagcaagccaggcctcataaatcatattcctcaaagggacgaaataaagtaagttcatggtctttgacaatgaagagaagtaaatagcatgtactcagataagtcccagagaattactaggaatatccaatgcctgagtccatactggggacatcaatccttcaattctgaagaacttagtctttgcaggctaacagtcctcattttgtgtgaagaaagggcagtggttcagctaatctggcttcaaatctcagatctgaaacttactaaccatcatcctcgaagctagttccctcacccctctctgagcctcaatttctactgtctataaaagggatagtgatacttatcacacaatgctattaaaaggattaaataagagtgtatgtgtatgtgtgtgtgtctctatctgaaatagtggtatgactaagacatcatcatcatatccaacctttatatagctttgactatgtgctaagcactgatctaaattatgtaaacacaatctcttgtttaatcttcctaacaatccttaccttgcagatgaggaagcagaggtacagggcgtcacatggtgagtaccgagcagagctgagatatgaacccagacatctgtgcctgtcaccaccccatgctactgtctcccacaaaatgaaaccacattggaaagtgtttttgtaaagtacaaaaatttttatcattgatagttatgaattcatgggccatgggaaggtttttttttctcctccaaaccaacctccccattacatgtactaatgtcagaaatattgttaaaaatagagaaaatcttttttgcatagccctgaagtgcaaatactaaaatcgaggggtgccatagtgactgcatccagtctatgcgagggcagaaaagggaggacacagggacaggaaaggtcatggaggagagagggcagaaacacccacattttgtttatttcacaacatggtctggagctgaccctggaacagttccagttgtgttgactcaggaacataattagggaaaaacttaattttccaaagctgtaaggttggtgtcaatggtttcttattcccaaggctaaaaactctaaagaatttttttttcaaagtgcggcataaccccaataaaactatggacttctcaaaagctaggtagacagcacctaaaaatcttagtccacaaattaagtttgtatcagtggtagatcataacctgaacatgtaaaacataagtgacaagattattcctgtttatttttatttctaatctttcaggacagctgccacttcccaagggcttaatatcttttcctactaggttctaccaatcacttttacaaagagaatggactccattccacaaggctcctaggaacccccacagtccaaatgtggttctgccaacccttacatagaccctctagtttcatctataaaaatgatcagcctgaacttcttattgaaaaaattcttatcttataaacttctgtttatggtcatgaatatgcttcaaactaagtgcaatttccacataataagaataagagcaaatatttatataatgctactatgtgccaggaaccactctaagcaatatgcatagattaatttctacaggtagctgctagcatttatcatccccatttttcagatgaaaaaactgaggcttagagtctaaatgacttatttaaggtcactcagctaagcggtagcagagccagaatttttacccaagtatttcagctttagaaaacaagcccttacctattcctttgtattaccactctaaccacttaatattttaagaatcaacttacatttagcattgttgctaaatttggatcgaattcttcctagagttccaggcactaaagtaatatcatccacattagttaggtaattactcaagaactcagttctatcacatgtgacatcttccattcctatggggagggagaaaaagaatattttcaggcaagactaaaacgaaaatcttaacatagacacgaaagataacatccaggcatctctttagttagtttttagtaacttaatgggaagagccctgacttttgagatttttgtatttgactttaaatggtttaaggcttctctgtataatcttttctctagacttttacttagccatatcatcttgcaagcactagaaggttgaaagtgcattacctcgattacattttaagtcactcagccagaatagcaagacaaaggaagtcaccatgatttaaacaacaacaacaacaaacataactattgacagagtctttatgaaaaagatctattctttaaaaaaaaaaaaaaaaaaaaaccctaggttgcatcaaactcttcccagctgggggtggtataaatggaatatacagttctgtgtctcttttacaaaatgtcattttccaactctctaatatatctcctgtcttgagtacataatcaccagtcctcactgtctccactggtggccttggatgttactgacaaaacaatactggcaacaagagatgagaaagaaaaatgtcagttccaatgaccacccaaactgaaaaacaaaataacactgaaaacaagttgtaaacaatgtaattagtcagaactgaaagctagcaactaaagcaagaaggttctaggtagggaatttttttaaacaacaaatatttctcctccaccccaagatttgttgtgtgtccccatcaaggaaaattcttttattaaaatgcttttatttaaaacattgttgtaaactcaaatcttagcatcatagactatggaggctactagagatcttattgaaatgtatgagatgacctggaacgttttaatatattgctcagtacaattcagtatgtacatattctctaacagggaaaataaccctgttggagaatactcatatatttatatcctgtaaaggatgcccaaaggttttaaaataaggaaatacaacccagagtaccccagatctggtaaaatttaactaatcacctcctaggatcccagatccagaaccttcccttgtttaatacaaattggaatgaaatgcaagaaaaaacacacagcataaggattatatatcttgcactttaacagttaaacccttaggaagaaaaatagagcaatgaagagctactatgttttagtacaatgttagcgtgggaagggaaagtccccaaatacctattaatagagggctgaaagtctttcccatttgttatatttctaggaagtcccttatgccaccccaaatgtgagcaatctcctttacttttgaagtccatcaggcactatgctaagtgctcctcaagcgtcatcagccttcactctgcagactaactttgtggaggggtgttaatgttctcacctgacagatgaggaaactgagacttgccacaaaaggtgtatagtgtcagatagctgttaaatgacacagtgcaatttgaactccactaaaattcattatgactccaaagaccatgccctaaaacactaaaccataccatcttttaagagagaggtgctgtacactttgggaggccaaggcaggcagatcacctgaggccaggacttcgagaccggcctggccaacatggtgaaagcccatgtctactaaaaatacaaaatttagccgggcctggtggcaggtgcctgtaatcccagctactcaggaggctgaggcaggagaatcacttgaacccgggaggtggaggttgcagtgagccaagattgcaccattgcattccatcttgggcgatgagagtgaaactccacctcaaaaaaaaaaaaaaaaaaaaaaaagaagaagaagaagtgctgtagttgtcccaaaccaaatggatctactcatcttggaagcctacacactgacaagccaaggttttaacctatccatgacctttacaatgcctcagcacatatcattgggacccttctacttagatgtctggctccagcatgtgagcaaatgctcttgacacctctgggcaacttaaattgaatcagctgtgacacatgctccaacttctctgacctgtgtgtagctctccactaagccgaatgcatggagcatgacttcgcaaagggttatatctagcccactcaagaggagaaagctaatccctttggcttttttttttttttttttttttttttttctaatttctcatagatcttctaggacattctggaaagaccttcaggaccagagctagggagatttgcctaccattcttaacagaactgccaaagagtcagccaattttcatcctccgaactccactagaagggagaagccccaaattccaatgctactgtttcaatctaatagttccggaatacaggagataccctttagaactcagtctgcatgtctctgagcccccaccccctgcacagctctacagtcatataatgtttatgatgctcttgatctcctcaaagaattgatcataaatttttctacttcataaagtgggatttagaaaaactacttcctataatgcttcttcctctctttaacagtcatctgaattacagcagggccttccggtttggaccttgacttccctcagtggattcggggaaatgatttgacttacacgccacttctttgacaagaatcccatatctctgcttctttatcatatttagatgtattttttaaccatataaactccatgggctcgttttggggatgtggctggcagggataggagattatcacctgatatgtcacattcacagaagaagctattaatgtcacaaggaaactgtctgtgttgctttaaagagagacagatttttgtagaaaggtctttcctgcaaataacagaaatatataagaagtcccagcttttgatcaaaatgaacccagggatctctcaggtcatctcatacttttcaatcatggcctgatttctatccccatcttaaagaaagcggggatgaggttaagaatggagtcttggcttctaagggcaaggattcttttcctcaatatgatcagaaacattatccatctatcctattagcaaagaaaaaacaaagctttaccatggtctccgacaaagatgacgttgacacaccgatgcagttttagttgtttcagtccatccattaattgccccacaattttgtcgatttccctcagaggatttgtcatctaggaaaaagaagcaagttagtccccacagggttttctttctttccctttcagtctctcatagatcttctacccctagaacattttggaaagaaaacttccggcccagaggcagagctttgtctggggagatttgcctgccattcttaatgaaatctggtctaagcacgttatatttgtattcttttgacagaattaaaacctctcctcatccaatccctttaaagattctttgatataaaaatgtcaaaaatattgttaatgaaaattctttaagagagaaaatcgactttctaatatgtgacagcatcctttaaatccaagagttttgagagtaaacagaaagtccctaagtgaaatcacattagattttgaactatggcaagaagatagacgctaagtgaattcaaagctgttctgaggttaaaatcacaacgttgcactggataataaattagaatatcattaatacaatgagatccatcttgttctaagtaatttaactgttggcatctgaaagcaatagattcttaacagaagaacctattctaagaaacaagttattgcttctcactttagttcttttaaagctgattttgagtgaaacaagaatctataagagtcctaacttaaaaagaagtgaaccatgagtttgttctagaaggtttcttctttaacaaaatatgaaaactcaattcttttctgaagaccatttccaaagcctaaaaaacattacccatatctcattttcttacttcaaatggaagtttctaacagcatgaatgtcctcacatactagaggctctccatccccctttcatctttagctgtgcaatggaaagatttttaagaaacatctgatcagacaaagaatagaaagatacagggagtatatttagatgaattttatagcttagctaacaatcacataaatatacccaagatgattaagataagaacagaaaggatgtgaatatcatttttactcggacacataatattatcttccactagcatcttctcagatgaatcaagacctttcctcctgttatttcattgggaaatcaggtgtaaacttttgtttttttcttcatgacgggagtcagtatttcaagtcctatcccaaggaggaagccacagttgaaagtttcagaaagacatgtgcagaataatcggaagggactaacgggtgtggaacaaagtggtatttgcttctgagaaaatcatgctctgctccaagatctctgtctaggtaaagaaataccaaatgaacaatgtgttttgatctttggcaatgacttattttcctttactcagcaggatgactcaggtaaaatccagaacctacttcttagggatcagttcagaggatcacaaataagatactgcctcagaggtattcaaaggttttaggaaaagcaacaaccgataggctcttctgaacatactgggaagagtagacattacttgtggaaattacatacaactctatccgcccattattttctctttctttctgtcttagctatttccttctctataacctacaccttttctgatctctgaaggtacagacccctaatctaagccaacttcctattgagttctaatccacattgtctttgagaatacctccttttaccttgcagggttgttctcaagaaccagggccacaaaccatgtgactgattctgtgaataagtgcactcttaatagtcactccagcctaaatgttaatactagttttagggcaactaactcttaaaaaaaggaaaagacttctttttttcctgtcatgttgagttcaggcagtcttcacatcagtgttaacctctgaagtaccacattcttctggactcaaagccaaggtcaatgcaccagagtttttctaaaacttgctcagccgattttccaaccaaggcactgaaggcaaccttcaactcagacctgcccgccacaaagctttggaacaatagataaacttactttgtcctgacgagtttccgcagcataatgatccatcctatgtatttttcttcttcttttctttggaggagcaactggtctttcctgtctcctcttaggggcaactttcctcttaggtctcttagccggagtaaaaggtgagccataactactctcctgtactggcggatagagatgtctggactcagaagtcgtctgtccctctgagtcagatataaagcttacactttcccatctgggatcagcagagtctcagaataactaaggctccttaagtgagaaaaaattggaatgagggatggatgattagaggaactctatggagagaagcctcctaaattgatgttgatactgttgtcacagcttcttcgctgagaacaagaatccaatttaagaaaatctagtcatgtgggtttcttttggctgatatttatggatgtatgggaaggtggcattagacaagctctgtattccataactcctgcattagggagagactggtctttggttatgaaaagctctccatttataaagaactaactgaaaagtaggctaaatactagccacttggtcatttcaagaggacaatgaggttcatgtaagtgattccaattcagaatctgacagttatctttctgttcacgtcagcaactatgtcaaagcaactgtcaccttcattggcaaggatccagtgaaaaattttaaaaccaaggacggaatgaaacataaataataagtaatcctccttaatcataaacgtactcccacaaatcaggactttcagcaggagagagaactcactgacaattaaggttttcagtacagaggaactctaagttaaagtccttttaaaattaggtaaaatctaaaaagtcatcaaaaagtcatctcttttttgtcttggtatatacagaccaagaaagagtctccttatgctcttgctatcagaaacctgcttttaaggggcgttgcatgctatgggttttgttttgaaaatccagagagcagtgaagttgacacataaactgaagataaccttttgggatttccaaatgctggaggaaaaacaggcccctgatttgctgatggtgcaaaggtgaattaaagcagcaagccttgctgtctacctcactgacttctctcggagggtgggtggggggaatgtcttgagagccattcagatgcaggaaggggcgggaggaggaacaatgttagtgtatccaagaaggggaacatctgccatgcgatttcactgtttccagggcaagccatggcaaaggcacttctgtttctgtctcatcctctctctccaccaaagcaatcaaaagacacagccccaaagactttggttttgtttgtttgttttttaatgctcctagttttaggcaaatctccataagaaaagcagcaaaaggaaaagaggattttccgtttcatggtcactgaatacattctgctagcgctcaagtcggcccatcaaactctatgccatttgcaagagacctcaacattccaaagactccaaagatgagcccttccaattgcagcaggttagaggagcagaagagtagggtttagtcaaactgggttttcatccagtgattatatcgcatgtatttccttcttcaaatgttagaggtacatgaaagctaagttttcactgaccagccatactttagcctgaatttagaaattttagcctgaggttattaagaggatgggaggtagaggtgcaaatttccctgcatttcaggatactttgccatctgaaggtagagactagccagccaaagctctgcctgtaggcccggaagagcagccgaacaaggggtcacagaaaaagcatagaaggtcaaaaagaaaaagattgcgccaataatcaaaagcaagcatatttttgaacattcaccattacactctgaaaccaggagcaatacaccatttcttgaactattaactcaatgtttggtcatctcatttaatagcttttgagaatcattctgaaaaaatgtggactcaaatatttagcaaataaagcacaaatttcaactgaattcatcttattgtagcatatagcattttggtagttaaaatcatttcaatgaaatttcaaatataggttattttcttatatgtaaaagatacgttactgattttaaaataatctttcaactagtatgttataatcttttcatgtataataagtgtaaatgatgatatataggtaggcatataggatacacaggtgtataaaccaattagcctacaatagaagagaatttttgctgacttgctttggtttcatgttttaaaagcataaactattttgtttttcattcagttaaaataagattcctagaaccagatgagaaataattgaaatctgaaaatatcctttgccttatgagaagaaaatgaccaggttatcagattaccattactgaagatatactccaagatacccaattaagagtttatccagtaggcatatgaaaataccctagctgcaagaagtagtaatactgaaaaaaacataacatgaatactttcaactcttaattcaaaggtactataggaaaaatctctgtttatatatttgtgagcaaccctgggcatagaaaaattattatagcaaattaaagcatcctgtatgccgcttcatttattccctactcagtactttcaaaaaaacttatttgtttcttaattcacacaaacatatactttcatgcatttaattgtaactgaactacacatattagaaacccaaagatgtttattgattaagaacatttatcattaagccatataacttttaaggtttgagttatacctcatctgtattattaaaagccaaacttttgccataaagaaaatgttctgtataatttgaacatagttattaactgaccactttgcttatctcctggactgcaggagggttaaatggttccatggaagggagtgtgctctgggagtcaaaagttctgtagtgctatcttcaggttctccccttagcagccaagcgaaagtaccggagtcctacttttaaaaggatggctataccaatccgttttgcctaccccacaggttctttgaggggatgctattacccaagaagtcaaacttttaagtagggaacatggaactgcttaggtgttttgttttgttttgtgaacattttgataaaatgtggttccttttgttccctttaggttaatctcaaagaaagtcaatctaaaaataaaacagccattcttgctttggtgttctttactggcatcatgtatgcagatgtttatctcattttatcatttgtgtttcacaatcatacaagacgggttaaacttcaaagggacagaaaaagagcatctgacttatataacttcagtgatttaagactaagagtggttttacgtagctattagttactagtgcttaaataaatcacctctgaattgatgtcaaagcattcagaaacacttatgactccttggtcacatgctgcaagtattgtcaaaatacttaagtattgtcaaaaaacttaagtattgtcaaaaatacttaaaccaagtatgtttaaccaagtatgtttaaaccaagatatgtttacctgtatttctaattcatctgaaaacaatgaacttaattatagtcagcagtgtcctatgggttactaggctacttaaatatttaaaaatatttaaaaggttagatttgcaaactccatcatattttttactatctatgctgaaaatgtgggaacatttctaaccattcctttcccaccttctgaatttgaaattatactggatactacctcacagattgtcttccacaatgatggctgagtgtttgataaaaatatgtcaccctcagctgggtgtggtggctcacgcctgcaatcccagcactttgggaggccaaggctggtggatcacctgaggtcaggagttagagaccagcctggcacaacatggcggaagcctgtccctactaaaaatacaaaaattagccgagcatggtggtgcacgcctgtaatcccagctactcgggaggctgagacaggagaatcacttgaacctgggaggtggaggttgcagtgagccaagatcacaccactgcactccagcctaggtgacggagcaagactctgtctcaaaaaaaaaaaaaaaaaaaaagtcagcctgctctgctaagcagattcattcagtggtatatttttctcaagaatttatgttactttgggggggtgatgactatgttcatatcttgaatgtggtgacaatttcacagtatatatacctatgccaaaatgtattaaattcaaaagggtccattactataacttatgccaagttgattgtattatatctgccaaggttattggagctgcttagctgatctaccctctctaaactgcctaatcatttcaagggtgctgaaattcatttacaatgttttgcattgcaggtttcatctcaagatttttttccatgcctagcccattgaaggcaaatgccaactcttccgaattattcaccctccaactgacgcccacaaggctagaatacaccccatctcctgttaacatcaagtttaggatatattattatttaaatatcaaatcaatctgaaatgaagctcctgtaacagaaacaggtcgttttaagattttttaaaaaatttttagtcttgtagttatttgactttgcataaaccttgtagatacaaacatccatccagactttatacaattcctgaaataaagtcagtagatcaggtagcccagggccacagattcttctcaggcagatgctaaaccactaacctcagggccgaaagggccatatttgtgtccagagaaatcaggttgctcagaatagaaggcatagaccgaaggcctataagaaaattggaaggttcagaatctctcctaaaccacatgtaacaaaaaatatcacatatttttaaaaaacgcatttaaaaaaaaatgttctcaagtttaatttatcctttaactactattcatgttagcatgaaaaacttttttttttttctgttgcttctgtgaccaccaccccatctgtagtaactgtctggaaccaccttcaggaatcaaaagtcacaaaggaaaacttgaacctgtactcggatccttgaccctcaagataacagagcctggcggtaattcacatgggccgtgcaatctgcagcctgaaacaacaactaactgcattacagagaagcgtctctctttatacttctgcaatccttgggatgctgctggttcatttatcaaagccagaaactcccttcggctctgctgtagtggacagaattaatagctgcagtaatccaagtaattaaatggtcccaataaccaaagtctattgtatccttcttagggaagtaacacttaaggctaagaaccacaaaacttttaattccaaacattggctgtgcttctattccacagtctagtgtttcacgcaattctaaactaagatagaaatgtactgaagaaagaagaaagagagaaataaatacctctcatgatctggcagggtgagccactgcaatatggttaatattctccgctcgtgagggatgacactggagggtaaaagcaagcaaagcatgttgttaggtttcatttccgcaaactcaagcctgaggagtgctcgctcttgcacccaggccaaatgctctctatttaccaccatctgttttcacttcatttgtagtaaaaggccctctttcgaattagcgtttaaactactatttccatttgcaacatattacgttgctcaacctcttccacagaagactacactggaaactctgattcacagtcagaatgaggaacctgtcttgctaatcagaaactccactacaagcagaaaggaccctggtttcagaatcattgtcatttattctgtcgagcctttagctgtggccataaagggatcagtacttacatccccaatccgcctcttgctggcggtgtgacctctcttgaccactcggtctcagtttactcatcggtaagataaagctaacagcaaagaacactgtacagcttggttgtaaggatgaaatgagacaagacaaggaaagggcatgtccagtgcgtaagacacagtaagttctttaaaaacatatttttattaatgatcataatgcgttatcattctgcctctaaataatggtatgactttagaaacactacctaacctgaaactttaagttcctcctctataaaataatgggttagggaaggtattcttgccattttcttccagccctgtaaaaatctaccaagaataggccaggtgcagtggctcatgcctataatcccagcattttgggaagccgaggcaggcagatcacctgaggtcaggagttcgagaccagcctgaccagcatggcaaaaccccgtcactactaaaaatacaaaattagccaggcatggtggcacatgcctgtaatcccagctacttgggaggctgaggcaagagaatcgcttgaatccaggaggcagaggttgcagtgagccaagattacagcattacactacagcctgggcaacaagagtgaaactctgtctcaaaaaaaaaaaaaaaaaagaataggcacatataattaagagactgacaaaaagggtataatcttcatccacaataacttttgtgtttaagtctctttcctctgttgaaatataattaccctaagtctggcactagctttaagggctctaaggcctcacagctaacatgacagtattgcatccccggctgagttacattcagatgctcacaagctgagtgatatctttagtcaggggaaattcacccactctttcccaacagggagcacaaaatgcattttcactccccgatccaagaccaggcattagaggcatgttcatgatgaattcaaactaaagcacaagtttaaatgtggtcaggaaaaattattgtggaacattggtgagccatttaaacttttactctcagtggacatgagcagtgagagagctgggagaaggataaatcctcaagccggggctctcatcaagtggtttctcttcctcccccatcaccatccagctcacagggatttgtcattccccaggcaccctctctttctggaactatcacacaagaccagaaaatcatgtgtgccataaaatgagtccaaatttaaacatattccaatgctattggataaatgcgaccctgatcactatatcctataattgaattagaaataggcagagcaaagccaggttaatcacttaaggaatttaattcttcagctttagaaatcctttgtatctgagcaaaataattgcatactttgaattctttcctgtttaaaaaaaaaaagtgaatgccagagccttttcattatactttatttcactacctgcctaaaagctgctttattttacgtaattggtgttaagccacagaaacgggccctaatgaacccactttcaatactaatggaaaaatacaaactaacagaatctgtgtcaagctcagaatgctcacccctgaatgccctcgttggatggggtacttgaacaatggtagacggggaattaaaagtgccagctatgaggccagagtgcttgggtttgtatcctgactccaacaaatgctggtgataagacttggcaagttatctaaacttttgatgcctctggaaaacgaggacaatataatagtacctatctcataaagttgtagtaaaggtgaaaagagaatacatttagaatagtgaaaagcatttagaatagtgctgggcacatagaaagggtttagaaaaatgttagcttttattgttatatactaaatgtataggtctgcagagatgatatattcattcacaaaatatttgttaagggcatattgggtttaaggcatttgtgtaaacgtaaataaagatattcctaccaaaaagactattatggaggggtcgtcattttcttgggggaaagataagcaagtgataattcttttctgggcaggggctgattgtgtttgtgttgagaataagatgaggacgctggaggtctgagtagccatcctacctctgaccttaggtgcaacatttaacctctctaggccttagtgttctaacctctcaatctctctcttttttttttttttttttttggttgttgttgttgagatggagtcttgctctgtcgcctaggctggagtgcagtgacacaatctcggctcactgcaacctccacctccccggttcaagctattctcctgcctcagcctcccaagtagctgggattaaaggtgcctgccaccacgcctggctaatttttgtatttttagtagagacggggtttcaccatgttggccaggctggttttgaactcctgacctcaagtgatccacccgcttcagcctcccaaagtgctgggattacaggcatgagccaccacacccagcctctaatctcttaaatgaggagttgggcaaggttgtctctgtttcctaggagttctagattatctttatgaaataacctcagagaccaaaaggacatggcccttagccattagcatttcaaatattcaaatacaatgcgcagacagcacaaataaatctgaccaagaaagagcaaaaaaagaaatggggtacatgttgctgtcttcaccaccactgattgatgcagaatttgtcatgagaccaagtatattagaaatggtcaaaaaaaaaaaaaaaagactaagttaagtatttactagtaaaggagagcaaattatcttaagtcatatatagcccttgtctagtcaatgttgaaagagagaatgtgaataagaaaacaaataccatttattagttgttctctgtgtaccaaataccctaataagcattttatgttgttttattttattttattttttattttttgagatggagtcttgctctgtctcccaggctagagtgcagtggcatggtctcggctcactgcaagctccgcctcctgggttcacaccattctcctgcctcagcctcctgagtagctgggattacaggcgcccaccaccacgcctggctaattttttgtatttttagtagagagggggtttcaccgtgttagccaggatgttctccatctcctgaccttgtgatccacccaccttggcctcccaaagtgctgggattacaggcttgagccactgcacccggcctattttattttatttttgagacagggtctcactctgttgcccaggctggggtgcagtggtgccatctcagctcactgcagcctcaaactcctcgggcttggtgatcctcccacctcagtctcccaagtagctgggactataggcacgtgccaccatgcctggctaattttcgtatattttggagagatggggttttgccatgttgcccagcttggtctcaaactcctgtgctcaagcgatccacctgccttccaaagtgctgagactacaggcatgagcccccaggcccggccataagcattttaaatatgttagctcattgcatctttgcaacatcccatgatgaagataccatatatgtgtgtgtgtgtgtgtgtgtgtgtgtgtgtgtgtatttttttttttgagacagagtttcactcttgttgcccaggttggagtgcaatggcatgatctcagctcaccgaaacctctgcctcccaggttcaagccattctcctgcctcagcctcccaggtagctgggattacagacatgtgtccccatgcccagctaattttgtatttttttttttttaggagagacgagggttctccatgttgaataggctggtctcgaactcctgacctcaggtgatctgcccacctcagcccccaaagtgctgggattacaggcgtgagccaccatacccagccgaagatactgtaatttttatttgaagatgaggacatggatttgttgagagattaaatcactagtccaaggtcaccaatctaataagcagccaagctgggatgagaatcaacgtgaacaatcatacataatgggaattactgtctttgaacatgaattggcacaaaagaatggagcatcagccgaagattatttcagaatgaaatactatcatttaaaaggcaagaataattctaggttgcagtacggaaccatgttaaaaagatggccttcaaagtctaagtctatggtttgaatcaggttctaaatttttttaagttttcagaatatacactgtgtagatttccttgacgtatatattctcttaactaactgaaagtgtgatcctatttttttaaagttgtaaaatacttcaaaaaaaaggggaaaaaatgaatccaagtcactttcaggatacagagttaaaataatagtctgagaagcaaatgaaagctacagacatctttggagcatacaaaagccaccttcttataagtgatttcaaatgggtggagaaaattgccattcaaaaccagaacactgggccttttcaatgaggctttgcagcagtttcaggggggcaaaggtggggactcagtattaattatgttgttggctcctctccattctgccaggcaaatatgttacagaacagaagaaaatacttctatgagcgtctatgacagtcaagagttaaagaaatgtcacacataggataacactggtaaatcaacatgctgtttatattaagcagtatcatttccaacctacctacacttacttctcagctcagaaacctctttaaaaaaaaaaaaaagaaagaaagaaatctcttaaagggacagtgtgtgctagattcaaatcaccaaacccaatttcaatttagcccttcaaatctgaaaaagctacttttatttctgattttagagagtatagacagtaccgttctggattaatttgagcctgcagtagctctcagcacactgctattatagaatagtcagatttttgttaggcatacaggcaaatacagaaacagctttaggtggtttaaaaaaaaaaaaaagatggaaagaacatctcagtgggaacaaaatccccgtgaaagttgaaacagattccttttcttactaaggaaccttaaaaatcatcaacatgttgatacttttattaggtaagattcatcttaaggcttatgaacattaactgcttatccccccatcacttctttagggatgggaaggagccccactttcttattagaaaaatcctggagttcagtgggaaaatgaggtgaaaatagaggcttccccttggtctcctgtctggaactttcaatctctagacgactccttcggctccccagaggcctgagaccatctagatatttttaagttgtgaaccaaaataaatataatatgttgtcatatatttatagaaaatgataacgacagccactgccataaatagtctaagagaaatatacatgtcctagatggcaagttaccaaaaacctacaaacaggaatagaaaaatctaaaggacatccggaaggaggagagaccatcttacattctgttgagaggatggggctgggcacggtggctcatgcctgtaatcccagcactttgggagacagaggcgggaggatcacaaggtcaggagtttgagaccagcctcgcaaacgtggtgaaaccctgtctctactaaagatacaaaaaattagccgggagtggtagcaggtgcctgtaattccagccacttgggaggctgaggcaggagaatcacttgaacccgggaggcagaggttgcagtgagccaagattgcgccactgcactctagcctgggtgacagggcaagactccatctcaaaaaaaaaaaaaatagagagagacaggatggaaaaaaggagagctggaggacaaaaagaaggtaggatgaggcacagagggaggatctcaggaaaaaaacacctggaaggttattttgatttagtaaatattcaaaagttctatattttcacatttaactgaaacaaaataaaacttaaattgatgttttagaaattgaatcatagctgtcattttataaacattgacaaaataaaggtaacttacacagaccaaaagaatgttccagctttcaccccttgcttggtggctgtaatccatagctaatgaggaaaatataagcggcttaaaatgtgttctgtgtttttgtcaaagaagaaaaagtttttaaaatacattagatcagatatcttatactctactcacaccccaacataaattttccattatttgcaaccatttattttcacatctggaagtcagaatcattatttccacaaatgttattcaatatattctctgcaaaagctctcaaaagctcctgctatgattctagtgacatattttttaaaatcttattttatctcaaaagcctctctcttctgtacctgtcttttctgatcattgttttgaacaattaacttatgcagcataattctgctcatcaaaggacccaagagtgggccatatgtttcctttactattgaaagcctcaaggaggagtgccccaatttggcatccagatgtcagaattttggaatccagattgtcttgttttagtttaaactagatgaatgagaagggggaaaaaggctaatttttaattttgatttttcctaaatcttttacctagccttttagtaaatgttattttagaggaaagttcctagaataagttaagtgaaccaagcatttcatcaaggtttttaaaatattctttacaccgtgtactattggggaggcataagatataggagtttagaacctgggctctgcaatcagacagtttggattttaagccttgtttctgtcacttaccagccatgtagtcctttggcaagttacttaatatctttgtgtttctgtttcctttacaatgtaaataatcttatctagcatataggattattctaagctttaatgagttaatacatttaaagtccttaaaccagtgtcttaacatctggcaaacactcgataaatttacatatttattgttatgcaataatggaaataaataatccaattattctagtaatattaaaaacagcctaagatggcaagtgtcccactgaacagaagtctatgagaagaaaccccctcacttaaagaaagagaatggaagcaaatacgagagagaattgtggtttgcctaagaccaaaacaaaaatgatctgggaattgtagccagccccttttctggtttcattgtcaccagcctttgagagtatccttaaagagtgacaacttattttttgaggaaatgggtaactgggaggtggagaacatccagaagcttaaccattgtttcaaaatcacctgggatacctgccctgggaaagctcgaaaagggttccagcccccttggagcctctagaaatcctcagccccaaactaacagctactgtagctggcaaatgagggatggggcaggagaacgtacagagcactcttcagtctgtgggttctgagctgctggtgaatttcatcagcctgggagaggtaggggcctcatcctgttcacatggctctgagggaccagaccttcttggccagacttttggttccctgggatgtttggagacataagaatctcagattgttctgagagtccttcactccatttagtccaaagctctttctattttaaagacaaattctggcatcctccaggaaccccagcccaactagggttcagaatgtgtcctggactttcattcattcttgttccagcacctccaccagcaagaagatgagctcaaatgaagtgctggacacactataaaaccatgccagttcccaaagaggccagttccttatattaagggatctattttcatacttattttaattgcttatacacaatcttagcacattccaatatccaaacaacttcctagatgtactgccttgctatttccaagaagattgtactaggcaatacttggcatctatgaaatttaagattaatatggagtttcctaaaggaaaacacacttttaatacaaatttctcaaataatgacctgcactttcaaaaagtatacggtagaatacatgctgatgttggcatcattagggcaacaggaagttctgagagttaatttaactcagtaatccttagggaaaaaagatcactggaagaggtctttacagtgtcaaaaggaaggagcacacagagtgaaaatgacagggtatgttaaaattattatgatggcaaaattaagatcatttgttctttatatttttctgtactttccaacaattttacagtgacaatcaacttacttgtaatcagaaaaaaaaaactaaccaattttaaaaagcagtgtcttagaagcatacagtgtaaactatggaggcaatttaaaggtaaaatttgtatttcttctaaaaacaaaatcaaaaagcagaaaaattctgcctgtttcttggtaaaagtcaggttgaccacattttcaaaaagaaaattgagagcatgatcagaaaagtataaaaactgaacaaaaaagataaaatacttaaaatgaaaagcacattttcccaagggggggaaaaaggcactaaaatattggtccagaagaagaaaagtgaatacaagccgataaggttataaaagagagagagagagagagagagagagaagcttcccggttccttgttaattcagagatataagtgtcaaagtttctctgaatttgaatgcaatataaatttcttcagagggtagtttaaaaaaaaaaatcaggccaggtgtggtggctcacgcctataatcccagcactttgggaggccgaagagggtggatcgcctgaggtcaggagttcgagaccagcctggccaacatggtgaaacccatctctactaaagatacaaaaaaccagccaggagtcgtgataggcacctgtaatcccagctactcaggaggctgaggcaggagaatcgcttaaacccaggaggtacaggttgtagtgagctgagattgcaccactgccctccagcctggatgacagagtgagattctgtctttaaaaaaaaaaaaaaaaatacaactaaaaaaataagcttaagaaaacactgggtttgggctttctccctctaatcccaaaactccctgcattgctttcctttatctggaggcccagctttcaacatttgtgtcctagatgctgctttgtgaaaaggggacaaatgggaatgacattgtatcttgtgatgtgctatttattagaaatcaaaaaggcttcctccacaggaaccaagtaggttaaatatgaaattcaacactttctcaaattcagcatgtagctttgggagaaaaggagaagtttggaaaaagaaaaatattagccaaaaacattttttcaaaaaacataaactactagtgcagtctttctagcagttcctcgaagggaaatcattcctttgcactcgaaagcattgagctaggataaacagaattctaggagaccaggggatcggtggagcacttgcttcagcagatcaatcgctgagaatcagaacaaattaagggtgtgggggttgggggaggcagcagaagagactggggcccaatgcagctggtttccacgtgattagggccagaaggaggtgagtgaggaagctgttggcatgtggccggagctgccgaggctgagatggagtgctgtccttaaggccacctaccctaggggaagcacaggccaaatatgcccccgaaggaaacaaagaacagttccatccgaaacacaatagcggagccaggctctagattgggtcttcgaaacagaaatacaccaagtccctacctgcatgggacccgcagtgtaaagcagacctgtgaataaccaacttcaaaaggaggtggtcaggccgggcgccgtggctcacacctgtaatcccagcactttgggaggccaaggcagacagatcacttgaggtcaggagttcaagaccagactggttgacatagtgaaacgccactctactaaaaatacaaaaaaattttatctgggcatggtggcacacgcctgtaatcccagctacccaggaggtagaggtatgagaatcacttgaacccgggaggcggaggttgctgtgagccgagactgtgccactgccctccagcctgggcgacagagcaaaactctgtctcaaaaaaaataaaaataaaaagagatttccaaatttatgatagtaaaaatataaaagcccaaaggacagtcactttgcttagccagagctggaaatgctgggggaaggaaggcctcctcgggacagacacttcagctgaaatttggaagaaaaataagaggctggtaagcaaaggcaccaggttagcagagctcgccctaactaggtacatttggatacagtacaaagagaaaaaactgcaggtctgcggtagtatatggaaaagaaacaacagaataaagaataggttaaatgttcctgaaaagaaatattgtctctttatcaggacaataaaacagataaaaagaggttagcaatgacttgtactttccatcaagtcaaccccttttggcctggaaagtcacccctattctgtgtcattcttcttctcctgctgtctctgtcttaaacacacatttcttgcattttttcactgcagtcattcactaaaatggcttctgttccaactcattgtaccaccaatactggcagagagcaattctaggtcaagcaacttaagtgataagaatgcatctgctggacagttgcagttgggatcacgcctgtaataccaagactttgagaggctgaggcaggcaccttgcttgagctcagaagttggagacaatcctgggcaacaaggcgaaatgttgtctctacaaaagatacaaaaattagccaggcatggtagtgtgtgcctatagtcccacctgctcaggaggctgaggtgggagtgttgcttgagcccgagaggctgagactgcagtgagccaaaatcatgccactgcactccagcctgggcgactatactaagatgttgtctcattaaatataataataaatttttaaaaaataataatctgcttctcttagaaacaccttactccagaaatgctgacttcaggagacttggatcatgatggggtattaaacttgtttctcaaatctccacatttagtcaactcctaggaatcccattcattcctcccattgctgagaatccagatttaaacagaacagggaacaaccccatggaagtatctttgtattagaaattgcaggaccgtagcagagagaatttccaaagaaaccaacccacttaaggaactccattaaactacgtatgagaaatgcagggtcctacagcaaacgactgcttctagcaatgcatgttgagtattaacaaattaaaagcagactagactttaattgactatatcaaggctaaaaaacaaagattaaattaaattataaaagactaaattaaattattttcggaagacgcctatttagattcaaattttcaaatggccattgtacaattgcctcatcccatctactagagtttatgctaggacaagaagtggcttttattcaccatgtaatctgacccctatgccatttggctaaatgtcttgcatggtttagtccctcagtaaaaataaattgagtttaatttaattatcaatctaagatttgtataaatattttctcttataaatgtataaaaaattataagacttttataaatattttttcactggtgattttaaaacgaagcctctgagaggatggtataaatgcttgtagaatattcattaattttttcttatagtacttttagttgcttatactcttatactttgactaaagtttctttttaattactttttatttataactgacatataataattgtgcatatttatgggatacagtgtgatgtttcaatgcatgtgtacattgtataatgatcaaatcagggtaattaccatatccataactttaaacatttatcatttctttttggtgacaacatttaaaattttccatcttaaatacactacattgttatttgctatagtcaccctactgtataatagaacaccctactgtataatagaatagaacaatactttgtctatatgtttttccaatatgccaaatttcaataaaatgtgtttttaaattgtagttactatgctcctgggaaatcttttttttttttttttttttttgagatggagtctcgcactgtcacccgggctggagtgcaatggtgtgatctcaactcactgcaacctccacctccagcttcaagcaattttcctgcctcagcctcccgagtagctaggattacaggtgcctgccaccacacctggctaattttttgtatctttagtagagatggagtttcactatgttggccaggctggtctcaaactcctgacctcatgatccacccacctcagcctcccaaagtgctgagccatcgcacatgagccaccacgcccggcccctcctaggaattcttatggtggccatcttgcccaagatgacagaaacactagtcagtttcaccacaaatcttggtcagcatgaggagagtactaaacttggtcagatgcgtcaactttgggagttagtgaggaaacaggtaaacagagctgaaacagagacttcacttcattgggcaggttaacagcatttcctctgctctgcttttgcagaagttaatgaatatgtggcctcatcttcttctgagtcatcctaacccaaagcaaaccttatgtcaacacttggtgtaaggtgatccaatttgataaaattactatttatctctaatcctttaaggttcttcaggtaagtttgcttccataatcaaattaatataaaagacccactagtgaaagcttaatggagctctaatttcaatcattttgtgtactcataaaatattcccctatcataaactttgaataatccaccctgtcaacaaatttcactatgatcacaccctaggccattatggacttctgggagtccagcctgaataaagacagcagaatcagagcatctattataaagaaacttatctgcagatgtacaagaagtctttcaatgtttatttttttaataaaaagctcatatttatccttgcatactgatttacctattatgcaatataaatattttgatcacaaatgaccttttcttaaagtgagataccttaagaaaaaatttctatttatagtccttattttgtccataaattgcagcaaaagatttccaggtacaagatcattgaggcatggtggatacatggatgtgtgcagacactgcccaccagtcatgccacggttgagtgcacaaagttctcccagccctcttctctaaccagtgctgcaggaagccactgtctccaatcagaattggcatgagatggaaccacttaccatcttacttctacatgtttctgattgcctgtgtgccctgggttatgttcctaggtgattctgatacttctggccagaagcttgtacacttcagcccagctctgcacattcaacaactgtggctttatgctgctttgctcatgtctgaccaaagcaagttgcgtaaccatacacacggtcacaggaaaaacattaggtagaaagccacctacaaccctttttattttctgcccagtcatttgatctgaagtaaacagggtgatttcttttcaaagtattaatttgctatttcagtatcaaggtaggattctgctttttgtatttaacttcatgatttttaaaaaatagattaaataaaaaaattcatgaatttactgtggatttcagtgagttccctttttttccagcaagtttccctgtttctgttattatagcatcagggctagcatattggggaagtcacagtcatacacttctcttttttattatacgcctaaatctgggaaatcaatgagatctgactatttctttgtcaaaatggttctgaaattcacctcatcaccattgtcaccaccataatcctagggaagacattcatatcatctcacttttataatcatagcctcacaaagatgcatgcatatatacacacagagacacatacacatatgtatacatacatgtatattctatgtgcacatatgtatgtacacatacataaatatataatatatacatatatcagatatataatgcatatatacacatatttcagatatatatataatgcatatatacacatatttcatgtttgtatgtatattaaaagtatcaaaagacagaaacattgccaagtatgaggaaattatacgcattttttccacatctaacaaatttggggatgaaatgtctcaatacatgaacacacaaacacatagacacacaataaatgcaaaacttaccggttgacctccccaccatctatgattaaatttctctcgccctcgcagatgaaaagtggcatcaaatacaggatcatacattgaattgccaacaattccatgtgattctggatatagcccctttttgtaaaagcaaatttattgttaaaataacaatacaataatccacatacattagttctagtatgaattttcttagcatagaaggttttatagcaatacttaatttccaaaattatataagacatgtataaccttcactgtgtatctgtttgagcaaacatgaataatatctatgggacaaattataagccatctgagaaacttaatatgattataagaaatttaacattggggtttttttctgctgtaatttaagaagatgacaataattttcattacaataaattaacctttagtttggaatgtatacatgtgcctccaaagaagcttctatttctaaatacacttttctttctttctaaattctattgctccccgaatcaataaaaatatataaataaattatgttttaaagaaggaagagtggtagaatttgaagtacctgaaaattaaaatatagccctgaagtcaacatttttatttgcaaattcagaaaataaacaatagaccctctggtatttgagagaagtttaatgtatgtgttcaaacagaactgcacctgaaaaaagttttcagctttaaagttggaatgaagttccatcacccacaaagttgtaaaaggcatttgctgtgaacaaatgacccagttaagatggaaaacagaaagattttctttgaacactaaggaacacgttttaaaagtaaagtctctcctttaaagtcattccaggatgaaatcagccctttgaatgtgtatcattcgaaaaaatacttacagtggccaaagtgtataagttaggaaaggttttagttgggtacaccggcctcatgtagggagagtgtgtgccacaagaccctggaaagagaattgcaaatattagaacaagagaaccaacaggaattgcttatagaaaatccattttataaacactcagacatgtgttaccttcacttctgtatttcaaataataaaacacatttaaaactacgtgcccatagatctcaaagcccacagcccactggttagtgtggagatcctagattacagataagaacacagagtatggaaattacttacttagtttttcaatattaggcatgactttgctgcctttcttcatgtatgatgcacggaagccatccacggagaagatgattaatggagggcgaacaaaccttaaacagtaacacattaagcttttagaaacattattaccagagttgccattacgcctagtgattctcaataatgggagcaataatttccaagaaaaaatttcaccgggcgtgatggcttacgcttataatcccagcactttgggagtccgaggcgggctgatcacctgaggtcaggagttcgagaccagcctggcaacatggtgaaacccccatctctactacaaatacaaaaatcagctgcacgtggtggcgggcacctgtaatcccagctacttggaatgctgaggcaggagaatcacttgaacaggggagacagatgttgcagtgagctgagatcgcaccattgcactccagcctgggcgacaagagtgaaactccatctcaaaaaaaatataataaaataaaataaccgaacatattcatttaaccatttaaccacaagccagtcatggttaaatcaagactgcccaacaaaaatactctgtcagtcattcattatctgaattcttgtgtatgagatctgttaaggtacagattaagaagtcatgaaacatttctgttttgtaacaaataacacagtgacctgttattattcattggtagctttttttgagatgagctatcaaggctgccctttctgccttgttcttcatgcctgcgaagatcatttttgttccggggatgtgcttcttgggattctccaaatactccatgagtgtatcctctccccaggagatgcttttgttcttatgggcctctgtataagagaatccaatggcctgatctgtcttccccacaaagagaccatggagatttgacccagccacctgtttgcctcccttttcaacagtgtggaactgggcacacttctgaacaaaaattctcttgcctttttcaacatcacccatatttaattctctctttggttgctggtgctataaaggttcccattcagaagccagatgtcccactgccttggatgccttttttttttttagagggggtctctttcatccaggctggagtccagtggcacaatctgggctcaatgcaacctctgcctcctgggttcaagcgattctcatgcctctgcctcccaagtagctgggattacaagcgctggctaattttttttgtattttttttttagtagaggcggggtgtcaccatgttggccaggctggtctcaaactcctgacctcaaatgatatgcccgcctcagcctcccaagtgctgggattacaggtgtgtaatcaataagtaataattacttattggataacacagttttaaaggttctcaggacttcctctttcattccccactccccgcaaagtaggcaaaacaagaactccaggaaaaacaatactgaaaaaaagtcttagccagaatattcagatgcactttgtaaaatcctcagctgaggtggaatataggggatgttcagaccccaatatgtgcagaggtgattggagaaaactggggggaagaaaactatcaccatttcaagacctaccttcaacctttcgactcatgaattactcctaagtactcataagtttgcctgtataagagaatttcagttccacattgtttctaaatacttctcttttcatttcctgtgagagtttatcagctaatacataaaacttcaaaatagtcataaaatacacttaccctgcagggcattctgcggcctttatttcctcacagtcatcatcaacccaatgcgactctcctataaggaaaaatgggtaaatgtattgttgaatctaattacaaatgccatgccttgaagctcacaattccaggatctgtgtcctgtttgatactttctttatgggatataacaaaaaaaaaaaaaaattctgaaaaaaaaatctagtgtctggtttggcttataaagtacacccatacatgatgggaaagctaagatttaataaccacaagtggtgaggtgtttatttgagccttccgagtctaaatggtttgtagattaaaaaaaccagtggcgtcagtgaacaaaatttcatgtttgtatccctccagaaataaactgtttggtcattagatggaacattcttttctccaccactggagatctcaaagccatagaaagcatggcaaaacttccctttagatgctaaaaaaaaaaaaaaaagtcttagaatctacagagataataagtggaagattacaatagaaagattatttgccaataaatctccatacagcccttgaatttagaaagaaaaaaatgctaaatttcactttttatcttccaccaagatctaagagcataatgtcgagaatagagaacagaaaaggcctcagataaaaacataagctttgctttgaagaaaatacaagttatcaaaaagaatttgccttaaattattttaagacaaacaaaagttacatatcctgaacagaagtaaaatttgtaaccaacacattggagaaattgctcccatgtaaagagaactggaaatcttctctggtcaataagactctaactactggacaatggggtaactattatgctccttaaaataaagaagatttgctacacatatagtaacccagagcacacacgtgggcctcacaaaagtactgaaactagaattttaaaccagtaaaagccaatgcttaatgattcaatgatcaatgattccaagggcttctttttttaaaaaaaattttatttctaacagcctttgtggcttcctggtacacttactgcacaggcaaattaaaaaggaaagggaaataaattctcaaccaattttatgcttcaaaataaaagcataattattgggtaggggaaattaacaatacaataattgtttgggtatggggaaattcttcaaatatattaatataacaccctcttgccacaactaaacaccttacatattgcagaagtaacttgatttttttcctgaaatcttttaatgaacttcttcttaaatgttccacatcagagataatgaaaaggacttgattttgaaatttaaaaagtgacttacaaacaatagataaagattcttggatcttcccatcaacttctataagtgggttgcacggcaacttaaacccattaaagagaataactgcatcttttatattttctgtagtccattaactattgttaattgttggaataaaagcatcatattctacaatcaaccagacaaagccaacactcatgcatatatggctttggggtataacaggaaatgctggccccctcatcccctttaccagcaagtacccccatccctgggcagttgccaatgccttggtgaacagtgtacatccaatagataaaaaagccctggttccttgcctcaagagtagtgacctggatttacttttcagagcaagcaatagagggaggcgaggctaactgagagcatgtcctcacttgtctctccacactcctccttccctatcctgcttccctttcctccgacatggttttcctgcagtatatccgtttcctcaataaactgcatgtaccgaattcctgtctcaggatctgcttctagaaaacttgacctaaaaccaagataggaaatttagaaatctcttcattattatgtttctgtctaattaagaaattctggtttcttcccttgttacttcagatcagtgaaatacagagtagcaaaactaatgaagaagcatgagaaattaaaaaggacaattcattccttcctcccaaactcatatccagtgtggtctattcctagcatccaggatctcctggagcacctccagtttttattcttttaaagctcaggccaatccaaagaaacacgtacctttgcaaaccacttggtaattggtacagcagtctcccctggccaagcagtcctctgagcagtgacaggcattttcttcatttctgacttctccacatctgtccttagtacactcccagccacgggctaaaatcatcccaataaaacattttcactgctgcacactaaccaaatgaaagaagccacaattgcttacaggatttccaatgaagaaagctaaaatctcacatcatttactctgcttgtgaaatttgagttggcttgaggcccagaggacatttggagaatttacagataagatgaatttctaagttttcaaatcagagaacaacatcaaaatgcaattgggttcctttggaaaaatggggccctgaaaggcaagcaagtatccctacgattctcgaattgtcctaaaggacccaacaaatttatgacatcaaaggtttatgatagggctatctactgttgtagggacagcctctatagcttggctcttttaatttctgaagtgggtgtgcttagctttatttttattttatttatttatttatttttgacagagtcttgctctcttgcccactctggagtgctgtggcgcaatctcggctcactgtaacctccgcctccctggttcaagcgattatcccgcctcagcctcctgagtagctgggattacaaacatatgccatcacgtctggctaatttttgtatttttagtagagacggggtttcaccatggtggccaggctggtctcaaactcctgacctcaggtgatcctcccaccttggcctcccaatgtgctgggattacaggcatgagccacagcacctagcctaaagtagctgtgcttagcgttaatcagtgtgattcaaacacaaataacaggacaactacatggtttctatctgcacctggaggttaaagtcctaaataggatgtgaagagtataaagggggcattacaatgtttgctcaagattctaaccactgacccattgtggtcctacctacaatgacaggtcagagttcctactttcaagccaagtaaatgggttacagatttccctctgaacatacctgattgacagctcactgcttaattcttacatttcagaaaaacaacctttccattttaaaaggagtgctgtgttttttgactttttcatctgctagagtgtaagcgccatggcaggaaaagtgacacctctctcttcgctcttctatttccagtggcagactgtaagcctgggagactgcgcctggcacatgctaggtgttcaatcaatatgtattaaattgaattggaaatgaccatggagataaaatataactctttaaattcagaactactctattgagaactttcatagttaactcatttactcattgactcttataccatgttttccgtgttctcggtgccaggatgtcataaagaacaggagagactaggtctgtcttcatggagcttacattccaattggaaaagacagatcataggcaagtaaatcaataagcaagatcatttcagcttatgccaaatgttgtgaaggaagtaacaggtggcattgatagagaaagatagggtgaaataggtgctactccaggaagtagaatggtcaagaaaggtgtcactgagctaaaatacatatgaacacttcaggtctttatctcttaaaatatgtgataagtggaaagaaatgatttttaaagcaatcctgcctcttagtaatattctaccaagagaaacaactattgttaggtgaatacattaataaagagatattacgggccaggctcagtggctcatgtctgtaatcccagcactttgggaggccgaggcaggtggatcgtgaggtcaggagttcgagaccagcctggccaacatggtgaaaccccgtctctactaaagatacaaaaaattagccgggcatggtggtgcatgcctgtaatcccagctactcaggaggctgaggcaggagaatcgcttgaacccaggaggcagaggttgcagtgagccaagatcatgccattgcactccagcatgggtgacaggaggagactccatctaaaaagattaaaaaagagagagagatattagttgtttggcataactgctacccctgccccttttggtaaatcattagccagaaaaccatgcaattactatttaatttttattcttttagaattacctttgcatcctgattctgctgtctgatattttttgttgttttgttttgtttttttgagacagagtctcactctgtcgcctgggctagagtgcagtggcataatctcagctcactgcaacctctacctttcaggttcaagtgattctcctgactcagcttcccaagaaactgggattacaggtgcctccccccatgcctgggtaatttttgtatttttagtagagatgggatttcatcatgctggccaggctggtctcgaactcctgacttcaagtgatctgcctccctcagcctcccaaagtgctgagattacaggcatgagccactatgcccagccattctaattttttaatatcccgtttccattcctatctcttctcgaggagattaagtgcttagaattgcttttcccatgacctgctcttcccaatgatgagcaatcttctaaggttgctttgactctagatattgtggggttttttcaattcaaggtgattctatccaccaataaacttttattccactcctaattccataagaaaatcacatctacattacttacaaaagaatatcattattaataagctatgtttattgaggaactattgtctttatgtacaaatgaaatataaaataaatccagagtttaaagtgaactatacacaaaggacaagtcagtcatctgtgtaattttcaaagcaaacatgggaataaacataaaaaatatttaaccttattggaaaataaggaggaggtcacctaccagattattttaaaaatatttttaaaaataagagtattcaatgctgaaaaggaagtgatgaaaggtccttgtgtcctttagtagaaacataaactttcagaagtataatttagtaatgtatatttaaatttaaaaaaaatgcacatatactttgaccccaaaatcccacttccaaaaatttatcttaaggagaataggcaaaagtatgaatatgcatcaattatattcattgatacatcattcataatagtaaaactcagggaaatattcatttaattactcaatgaattaggttgcaacagttcaatggaatattacatagccattcaaaaggacgatttgtataaagatttattaatacagatactttcgcacacatgcatatatatacacacagttggaagagtatacatgcacacatagatacatactgaaaacacacacacacagagttatcaaagtttcgctgaaacattgtggttgtttctcggcagtgctccctcaacaaaggagaatctcagagccttttgtttttctattcatccttttattattatttgatatttgattccttcacattcaggatatgttatctttgtacacagggaaatggactataagatattatatcccatccttaataaattgaggaacaaaggcatgaactacattcaaaagagagctaagctagagtcagggattcattacattttgcaaagaattctaagaccaggaatccagaagtttgatatgacatgccacagacaagatattcaaggtaaggaggaaacataaaacattagtaaattcctcagtgccaagcaaacacagattgctggcttgaaataatgttttagagccaaaaaaactctgctggaacatctgttccatctatacattcagtttacaatagtctcagcaatttagtttgcagatccacaattaaaagaaactgggagaagttccaaaggaaagcaacccccaaaaaagtggttaaatggttggaaaatgtgttctgcaaaaaacagcctaatgaagctgttcttattgcagggacgcaggaggaaaacaaatcagaactagtaaggaagtttatgttggatttcatataaatcaagagctaccacttaggcaaaacacagtaataactgtttctaatgataaaatttgaaagatcaaactaatagcaatgatagtaagagttaggtctttgaaagaattgtctaagcataaaagtccaaaaacaagaaataacctgccaaggaaaccatggaaactgcttctggtgatgtcaagaacagcattgacggttgtctttctcagatagtttgtgtatggtgttgtccagaagcatggtggatagcttacaagatatctcaaaaatcctatctgaaatattgtgctttgaaaacagagtaggtgggatggcagaagtccccagaggtgtttttctcaactcatgtgcattcatacagaagcctgtacatcctagtaactgttccagcacaaaagaaatgtaaagaaagtcacaaaaagtgtggaggaagattttagagctacccagagcgtgagactccaaacagaattccataacaattttccatttgcagacggcagggaatgacaggcacactaacagttactgtacgataagatgaagtgaaacaaatgctagaagctgggaaagcaagaaaaaaaatttttttaaagaatgtacacaattaggccaggcacagtggctcactcctataatcctagcactttgggaggctgaggcgggaagatggcttgaagccaggagttcaagaccaacctgaccaacacagtgagatgctatctcttaataaataaataagtaataaaaaagaacatacacaattttagcccacaagccctagcagtgaatgtgggaattgacagaaagatatagaaaggatgaaggtgaagaaacaaaaacaaaaacaaaaaacatttgcaaaaccagcacatcatgactgcagctgcaaagaacctttctctgctggaacctatgtggaaacaatggtcattgacatagggtatgctcttcaaagaaccaataatcattcaacaaacaaaactagaatccacagtttggatagaccaaagcagggtggccactccaggatgcatacaatagcaggcagtctttaagccatctacttgaaggtagagaggactcataagttacgtacctgtcttcaaacacagctcatcaaagtcatggcagcaactggtatagctcttacacaagttgtcacagcgacaatcaggaggtccagcctcttgaagttcaaagcacctgcccttgcaagatccggagatgttggtccagggggagtctgatagcactgcaaagaacaagaggcaaaaacaatggactggagagtggtcatgtcaccatggaaaggtggcactgggaagctgtgcggtgtgatgctgcagtggactctggaggagaacactggctccattacttactacccatgtactctgggcaggttgcccaacttccttgttctacgatttcctcatctgtaaagtgggggactcataaaagtaactctatgttgaaaagagaattaaatgaatcaatccatgtaaaacacttagccgcatgtcagacatatagaaagagtaacaagtgttggtgatttgttcaattactatttataattattattactgcaaatctgtgatgattagtgcccctgtgggtgctaacgatgaccacagagaacagtaccttgatctatatccttagaaacaagagagcatgtccctatttaaaaatccaaaactttttacaaggaaaattcagctcaaatgttccaagaacagaacgaatatatgagattggaatagaagacttttacagtttcagctagtgttttacaaatacaagctctataatctgggcttctcaaaaaactcctccatcaatattttcacatgatataggtgtatatcagaaatcaaaagaatcaactaaaatttggggaaaaaaagaattcagtgagatcaaaattccacaaatttgtaatatgcacacaatatagtttcaaaattaaacagaagtttcattctcaatagggcctaaatgataaaatagctaggtattttatttggtataaatttaatcatatgtatgtagaaccaacatacatgagaaaagtctaccaaaaaaaaaatttttaagatctaattaaggtgggggcaaggtgcctcatacctgtaatcccagcactttgggaggccgaggtcggtggatcatctgaggtcaggagttcgagaccagcctggccaacacagtaaaacccagtctctactaaaaatacaaaaattagcccagcgtggtggcaggtgcctgtaatatcagctactcgggaggctgaggcaggagaattgcccgaacctgggaggcagaggttgcagtgagcagagatcgcactattgcactccagcctgggtaacagagtgaaactccgtcttaaaaatatatatatatatatatatatatgatctaattaaaatgaaagacataccaccttaaaggtaaaaatatcaatattataaaaatattaattcttcctaaacaaaccagaagactcagtgcaatcacagccaaaaatactgagagttcatgaaacttgaaaaaattttaaacacttatttaaaaataaaatattttaaaatagaaaacctctgaaaaggaaaagtaatttgataaagactagatagcaaagtatattctgaagttaaataatcaaagtagtctgatactagaaaataagtagattaatgttgtggatgggagccaatcagtaagtagggactataaataattaagttagggtctcatctcaatatacaaaataatttctgctaaatggaaaatataaacagcctcataactgtttccaggaattaaaatttttgtaaagtagaatataatttagaaagacctatcaacatgtttaaatgcttataaatgtttcacccagaaattctattactagaaatttaccatttacacatatttgcaaaagtttgccaagctacatgtacaaaaaatgtccattgttcattgcagtccttttattacaggtaaagagatcctgaaatcaaccaaagttgtttttcccgtcaagaaagaaagaatcgctatatccataagtggactattgcaccgtaagaggactattgcacactccttaaaaagaatgagtcagatcggtgtaggctaatatggaaagatctacaaaatatataaataagttgtttaaagaataaatacaggatagagtgttatatattagactttgtgtttaaaaatagagataaacagggcaataaggatagaaatgaagatagaaataaaaacagagccaaaactagagacgagtgagagacagggtagggcagaaggagggagaaaatgtccaagtttgcatcacgtttttaaaatgcaggtgtgaacaaactttttccttctgtaagaaacaggttatggaattacatttagggaaaatgagaaagaaagaggaagaagatttttaccttcctgatgtttgaaatttctaacattctacaaattcacaggtagttgcctggtctttttgtttgcttacttactttctctttccttctctctcattatatataaataccatacaatatatgtgcgtgtgggtatgtatatttatgtacaaaatatatactgtataatatatgtctgtgtgggtatgtatacatatgcacaaaatatatgtcatatatgtatgtgtgggtatgtgtatatgtacaaaatatataccgtataatagatgtgtgtgtgggtatgtatatatatgtacaaaatatataccatataatatatgtgtgtgtgggtatgtgtatatatgtataaaatataccatatatgtaaatatcctaacaaatattattgacatgcgatttataattttattttcttatttacatgcttatgaatttttcattttttataattcatgttttacttttaaaatcaagaaaaagcaagaagcaggagaagaacagatgttaaatgtcacttctaggttcacccaagccatttatctgaacattctgctcatcccttagtcctttgtcctcgttaaagtcttaaagtcagagtcatccaatcccagcctttatggcatcagatcagttcaactaaagcaaacagatttaccagatcatgagatgtgaaacacttttgcatggttgctcctaggattttgaaagacatacaaaccgtacgagttcagtttagaaaataatattcatttccaatgcagtggtccataaagcacatttttctattgtctttgaccaacctatcaacagtgcatgctgaaccataagaaaccatggaggcaggaggggttgagaagtaaaacaaaaaaaaaattacaaaacagaaaaaaatagagaaagtcctacagtaaaaataaatataaggaaagtacttacaattgaatattccttaaggatactgcttagatagactcatttcaacagcgttctagtaaattttcagtagaattcattcccacgagctgcttaaataaataagcttagctatgctgatagctgagatacttcaaagagatctaaaggcaatttgtttacagatgtgcggtgttcctgcatgcatttgaaattgtcctgcaaccacgcgccttgctttccttcatcatcatttcttccctatttctttcttttttttttttgagacggagttttgctcttgttgcccaggctggagtgcaatggtgtgatctcggctcactgcaacctctgcctcccgggttcaaagggttctcctgcctcagcctcctgagtagctgggattagaggcacccaccaccatgtccagcaattttcgtatttttagtagagacagggtttcaccatgttggtcaggctggtctttaactcctgacctcaggtgatccacctactttggccttccaaagtgctggggttacaggcttaagccaccacatccggcctatttctttctttactttcagagtatctgtgtgaatttttagccacatttaatctttcttcactcattcacctgatttttactattttcttacaacattaatcattctctaaatttgtcctttgctttgtttttggaaaataattgaatctcacttaatagtcggtccctatcagttacagttcttgccaaacctaaagacaagcaaaactaaagacaactttgttagagttagccttacactcataatgccaagatgtatctcaaaagaagtactgtacttaagatcaagttattgacagcttcaaattagggtatactcctggggctgggtggattaggatatacctatgtcaaaattcattctcggatgatttgaattcagctgagaatgacaggaaagaaaaagggaaggtagtttgagccatatagaacctcttataaaccaataacccaaataaatttgagctgctatctctttttttttttcttttttttcttttctgagacggagttttgctcttgtcacccaggctggagtgtaatggtgcgatctcggctcactgcaacccccgcctcctgggttcaagtgattctcctgcctcagcctcccgagtagctggaataacaggcacccgccactatgcccggctaattttttgtatttttggtagagacggggtttcaccatgttggtcaggctggtcttgaactcctgacctcgtgatccgcctgccttggcctcccaaagtgctgggattacaggtgtgagccactgcgcccagccatgctgctatcttttttttttttttttttttttttttttttgagacggagtcttgctctgtcacccaggctggagtgcagtggcgcaatcttggctcactacaagctctgtcttctgggttcacaccattctcctgcctcagcctcctgagtagctgggactacaggtgcccaccaccatgcccggctaattttttgtatttttagtacagaccgggtttcaccgtgttagccaggatggtctcgatctcctgacattgtgatccgcccaccttggccttccaaagtgctgggattacaggcgtgagccaccacgcccagtctatctcttttaaataaaatacagtgagtgtatgatgacactcagtaatgccacacactcctgtgtgcaatggaaaagaccatcttgatgagtgtacaaaaaaaataaacaaaatgattaaattaacaaataaataaaatagaacaatagagtggaatattcactctgcctttccagggtctattccgtcccagccatcttctttcacgacaagctctagtcccaactgttttcctaggagttctgcaatccaccttcatattctttttttaatcattttttatggatgaataatagaggtacatagttttggggtgataatacattcatgtagttgataaaaatcaagtcagtatacttggagtcttcacgttccctgtccttctccctacacccagcctaagatgtttaaaatcaagaaaaatcaagaagcagaaggagaacgatgttaaatgtcatttccaggctcgcccaagccatttatctgaacattctgctcatccctcagtcctttgttcctgcatgcatttgaagtttttaggacttctctctttattgtacctgacgtaatgtcaaatagggaaagattatccgatttgttagaagtctgagttttaaaatctgttgtcttcctttacttgacctaaatcaagagaacattgatgtaagcacttcagatgtgtaacttattgagaggcgggatgaaaactgaaacatcaacaaacttgtggtatcccaaatttttcatcattactgagatggccgtaacagcgcagaaaacaactaaaacaaacaaaaagtactctccaaatgtatcaaggcagaaatatgtgataagtatgatggaggcttgaaatttcttatgaggcatttgctaatacctttatgagattcaaattctattgccgccttttaaaatacatattcaaatgatgttattttacttcaaagatgcaagtcagttccagaatcttgaaaaacaaatgttcatagctttatatagtgttcttttaaaaaatagaaacctcaaattttaaaatacacataggtacatatatgacatgtataacaacaatgcaatgcatttcttatttttcacagaagcataatttcatgatttaaagaaacaccaatgtaaaacatacgttatttcattcaaattcataattctgacagaaacaggtacaattacttttacttaagtcaactttatgtctaaaatattccatcttacaatatgtatagagaggtagggttgtagaattctagtgccggccgggcacggtggctcacgcctgtaatcccaagactttgggaggccaaggtgggccgatcacctgaggttgggagttcaagaccagcctgacaaacatggagaaaacccatctttactaaaaatacaaaattagccaggcatgggggtgcacacctgtaatctcagctagggctgaggcaagagaattgcttgaggtggaggttgcagtgagccgagatcatgccattgcactccagcctgggcaacaagagcgaaactccatctcaaaaaacaacaacaacaaaagaattctagtgccatctgttccataagatacaacaaaactattgatgatttaaatttttggaaggagcctaaccgatgacaaaagttatggccaaaacattacttgatctaaggctcccaatcatatttccctctaaatgtcccccgtaaagatgcaaatactcaaatctggatgatggccaatagaagaggcagtatttaagtttggaaacatttagcttagcctaaagggggaaggttcttctaagctttgtctgctcctgtttatgatactgctctctatctgttcctcccattctccttggttcttagcccaggtatttcctgaaagtgagagcaaaaccttaaaatgtgttaccagctgtggttataccagctccttttctcaagagcgttaaaacaggacaagttcccttatgtctgctgccctgtttgaagcataacccacagggcaaggcagaggacagtgtgcgtggcattcaagatgctgcccagctctagagttaatactgtattatgcctcttctggagtatatggttcgttctttctggtcatacttttttcgtattgaatttgccattttttattgatgcttctgacctcattttttagtaaatagaacttacacacaggtctacatgtcagtatctttgcttcctaaatacataactttttataaatatccattactgcaacatcactgttctctcctcttcacagctgctaggccagatttcataaacttttttttttttaataaagaggtccacctgggaagtttttaaacacctgtgctttcaaaacatttataaacacaatggtctgacctgcctcggtgactcatgcctgtaatcctagcaatttgggaggctgaggcgagtggatcacctgaggtcaggagttcgagagcagcctggctaacatggtgaaacctcatctctactaaaaatacaaaaattagcctggcgcggtggtgggcgcctgtaatctcagctactcgggaggctgaggcaggagaatcacttgaacctgggaggtggaggttgcagttagctgagatcacgccactgcactccagtctgggtgacagaatgagactctctctcaaaaaataaatacatacatacatacatacatacatacatacatacatacacacaatgtcctcatatagagctcacaaactagaaggaaaaaaaaagatttctacgtaattgaagttaaaagttaaaaactttacttcaacatctaaaccacttaaatagaatttaatggccatcagtagcataaatctgaatgatttgcacatctgctaccaaacaataaaatgttgtcatttaaaattaaaggtattgttaactcaataaggtataagtttaaacactggccttcaaacctaattgaagattaattaaatgaattatcatatacttaacaccttatagttctcatcagccttaaaggcattttcaaaaactttttcagataaataaaagcgactttatccccattttcctggttggaaaattagatctctaggccttgtatgagttagccaaggcctggataaaattttagatcatctcactgtaactacagtatttttttcattaatgaaaggtttttcaaacttttgtacatagttttcaaattttagaagttcttttcaaaatataattttggggaagatttgctgattttattgattcaaaaatctaggctgaagttcatggaagactgagatttctgagtatgtaaactagatagaggagtctctacagttttcagatagatgaaaaatcactacactacagccccatttaacaaagaactgaaaaatctgtaccctccttagcttccagttcagataatttcattccattgactcaaactccccaatttctacctgaaatttcacataaagccccatgacaggataatcctaatgaccgagttttgctcacagagcaaatggctgatctacgtcccctttacagtttcctgcattctcccatgccaacatttaaatagcttttcattgcagagcaaaatttctaaaattatcaaatgaacataaaccttctcacttctagttccattttctgatttccctatgattctcaaagaaaagctttatccataaagttgttagtgacagtctacatttcatatgaacctatgaatttcattcacatacttttcaactttcctttcaagccactaaaaacaatgatgaattaaactgagcttttaagtctctgttagccagctattcacaagctcacaaatttccttttgtcttttaagaattaaattacttacatatcaaagaggatattctatttccacctggagacagtttctaaatcacaagtttcaataaaatagactcctgcataacaccacaaacatacacactgcaagtgcacatgagtgcacagacacctgtagacatataaagtctcttgcagtcttaaaggcaaatcaagtgggccacatcagacatatgagaaaaagatgtcaaactaaatcacagttatggcttatattttcttagaaaatttattccacccatctcaccgtctcattaacctgaatgcccattgtatttacccaacagaattataagtagcttttctcatttcatatctcctaataaatctataaatcttttatgacctggtataaaaaatcctgttcagccattatttcctacgctaacaataaatccaggtaacaagtgtgttagttaattaattatgacagtctgtttgcactgccacaaccttgaaactaacaccccagtccatagtacagcagcgagggcatccatgtgtacagaacattctcagctattgttgaggactctgagaagctatggttactaaacaactgcatgcttttgaatggtggatctcactctgatcaatccgaagctagccatatatcaataccctttgtgttccttctatttgttgcacccttggagcactgagcttcccaggatttctttggcgcctaaaaatgttgttggaaataggcatggctgcctcctccccacctagtgtcttattcttacaggcttataaaattcacccagtattttctgatgggaaggcttttctaatggtcagaataaccagtcacatgtgtcaatcgagagagatcctttctaagcatatgcagcatttaaacgcataaagatatttccactgtctacaggatgcttttacctagtttactaagtacatccttgatttttattcaggagaaatcaaccacagttcctaaaaagcacataagctacatcaaaagaaaaattattcaggcatatccaaaccataaaattcagagttaggttgcattgtattctaagactaagcttcacgtggttagaagtttaataaattattttagatgatatcataaaggcctaaaataaccaacgacttaattaaataattcaaggagcaaattcgtgtagcccacttaagaccatttaggtttataaattataatatagaccatactacttttctagaagtggcatttattcattagttcatatagctattcttataacatggaaataatttactatacacaaaatattttcaaagactaataaatccaatctatacttttcaagttttccagtagtgagcacagaaattcaagaggcaatgaaacagaataattcctgggattttttttttttaatccagaaagaaaagtagaaatcatctaagtctgctcctcattgtacagctaaggaaacagacttcacaagtgacttgcccaacaccacacagcaagttacaggactccagggtaccagcctaggattttaatgactgttttccaaaagaagtcacctttaaaaataatgagtgactcaattttacattcattaaggaaacagcatttaattctttcaatctcagttttagccagagtaatatattaagaggaaacagaaaaaaaaagttccctttagtgttcattgaaaagaaccagcagttggctctcaagttgctagctttcccacatgaccatgctaaggatctgattcccctgtctgttcagtcacagtcagtgttaatgggagtgaaaaagaggcctttgaagagagcatttgctgcaaataaaaacagcattctctagctcagtgatccactgtcctctgcctccccaacagaagacgactcattttgtccatttggctccctggggctgcaagttttgtgatctattttctcactcttaaccccgccacaccccacttcaattcactaattcacttctaatattattctttcaacctactggcatgattcaaaagtaacttaattgatgtaaggaagatttagtattccatcaatgtatgtgtcctaacccggttgataataaaatttcaagctggctaaacagaggcaagtgatggtctttcataacaatcagatcaagacatacagagaaacacaaaattcacaggaagacagacaaacatgctggaatgtcaggaaaagtccagaaaatattgttccctagagtgcccattacttaaaatgtaattttttatttctaaaaccatcagcagctccaatttccaggaaattaaccaactcattgcttaagacctggtcagttaagccccctctgtctgcacaaggagctcctttataagaacactgtatgggaacactacttatggtgtagtgtattgtaaaaagaaactctttcactttggttctattatttaagtcaaggtacactattaaaacttacctttcctttgccataaggacacacaatgaggacaaatcaatcctgaaaactctttaaacacctcctctcttttatgtttttccaattttaagtaaatcttaaagtcctaaatttctgaagtttcataaagatagctcactgccttttttacttccattcctttttcctacatcagaactttctagtggcaaatactacatcctatatcatgtgacagcaaatcagatttgggtagctccaatattaaaccaacacctgttctcaccacttctactttagccttgtctgtgaacaagagttttaattgtatcctaacatttacaaatttgagtacaaaaatggaaatagccagttatgaaacaatcataaatgttctctaatgaaaaccacactctcccacctgaattatacacataggtggttttacccagagaaatttaggactaacttagttatactgcaagattgtattaaaaataaatattttaataagcttacattgattaccccgtatgtaatatttttaaaaaattgaaaatgcaaatagttttgacacttacctgtaggaggaccttcctcccatccttctgctctcttaattcgatgtgcagtgaatcctaagcagatattgactccaacggcaaaagtgaacagggatattatctaagagaataaagagaccaagttgtcaaatacagctggagaagactaaatcaaattacacaaaggtgattcaaatggcttcaatatcaacacccaatcctaccacttccaaaatgcataataaggtgctatcttaatttgcacaacaaaaaggaaaatgccaatcagtcactgattctgaagatcaagcatgtcccccgtcattcctccgttctcccacctgacacgactggaacgagctcctccttgccatgtcgaggattcttggaaagccttttgcagcgtgttctctttgccttcacggagtgcactgctttgaggctctgggtttagtctatt

SEQ ID NO: 322 - DNA, 81787 bp, Homo sapiens
ccagaaaaaactgaatgtgtgatttattatgtttaagattggtttataaggcttaaatatatctgtcatagttaacagttaacagcaaataaaggcaactttacaaaatcagtgtttccatacagtacaggactaaatgtggcaactgtgcattggaaaattaatatttcctcaatgcaaatatcaaatctgcagcaccatttagaagcttccactaaaaactcaagctgcagtatttattacaagctctactcagaacacaaggctacctaaatcaagcattagagaaaaacagtggagtcattcaggcataatatgtcagatttggtacaggattaaaatactaacatttttaatgtcctggtttcaaattaataaatacaaaaacaatataaaaatatacaaccagttgataagactgtactgcagatgctcagaaagttaaatctcgctctcatatgtatgcaggtatgtcttgagtgtcaggatttctgggtagctgcggctggtctttcggaagaagtccaggctggtgagatgttcaatgtcacgcaccctagctgtgtgcatcttcatgagttcttctacccattttgattcgtcctctgagctctgcaatggaaacagaacaaaatcagaatcagaattttccagaggagtttctccaaatggtcagtttactccaagtccacaaatgacctctgtgcactcttgcacacagagccaacgcatgttgatccttcctggcctccctgccactctaccgcattcctatgggtaatgtgccacaaatacctgcccttggctgtaaacattttcaacagcaattaactgtaccaaataaacgagacatgtggtgtcagagggcatttgactcaataggttctcagaacataaatcaaaattaggaaaaccaaaggccctagagaattcagtaatttgtttcttttccaagctgtcaaattgcaatattgagcacagagtacaagtaacttggaatatgcttctgcttcccaaggaaagtgaagaacttaagcctaatgcacgaaatgatgtgtgtgcattcctagtttttcaaaagaaactgctgcatcaaccacgtcatctactagaatgcataaattgctatttgaaaaatgaggtcaactcgaaaccactcagttgacacatctggcactctagggcccaacaggccagagttggaaatgaggctgtactacttcttggctatgagaccttggtcaagctacttgacttttgaggcctcagtttcttccttggttcacaaggataataatgcttacttctgcagctccctgggaggttagggaggagaggagggaagaagcggggggaaaggtaaagcaaggaaacacggaaaaaagaaagtgaatctctgcctcagctgcttgccaaaaattgccccactgacacaagttgcagatgaaagacattcagatgtcctgcatcaaacaacttatttcatgtctaacttgaaactaaaaggtaattcaggggaagcagttctttgcatctcaaaaatagcttctttcatttttgtgggaagttgagggaaagagtgagatctgagagccctgtgaatatggagcagtgtctactttcattagtagacattgagcaggacctttgcaagtaattccattcacaaatgcctctggaattgcaatggcttccaagagcccttctacaagttgaagggtggctgcatgtcctaggtctgggaatattcagacatgccctcatccaactctttaccaccagtggtctcagtgaactatccaccaaagcccaagaacctgcaatgggctttctcggaaagctccaacccacacaaacctggacagggaactgcagcagcttgtgccagtgctaaatatgttcgggagggtgttggttcaggaaactgatgcctggccatctcaggcaaaatgaagaaaggggaagaaattgctttgcaggctggggaggtaagaattttaaccttcatgtcccaccctcctaacccaacctaaccaagatctctgcgattcacaggaaaggaaagacctaaatataactctacccacaatggtactgaccagtcctcagtgtgaccctataattaacgaagtaggaggtctccagatgggtcaggaccccctcagagtaagcagggcaagcatgagcctgtattttgagagaattttcatattcagctcatttgtttgatttttcagtggtcagtcagtccaatttttttctttgtaaatgcagtcattttgaatgtgtggacaggggtgaaaaggtttttcctaatttaaatgatggctagctgggattataagaattctgcaaaaacatctgtcttttgctatttctttccttgggaagtgatttgccaatttcattggagaggcagtctcttccggttctcacactctgaaatctgttctataattcatcattaggaaatactagctatgtggcatgtgaaggaaatatcttctgccttgatgttcgctggcaatccacagaagcattcgctgatgaagactgtgctgcaagatgcaaaactaagacaattcagataaaagttcatgaacagcaaggtagggaggacaggaaagactttaaaaataaagcacttagaatattaatgcaaacaaaagcacaatccatgaacttgcttgctgtcttcctcattatggacattgattcttcacctgtcttttctccctgactttctccccaggtttgtgaattcaagtcccagaagttttaaggtaaaattcacagcaaggacagcttctacatgaacaggtgacccttcaacgagaagcatgctggccacgaactctacaagaagtgcctccagactctgtgcagagtcaggaaccagtagggagaggaaaacctgtaaggacttcagtggatttcatttatcagatataaaatttagatcgattacagaacagcctttgtaccaagtttagagcagtatttttaaaactccccatcaccaaattcctctaatgaccgaacttgaacatctattccccaggaatctaggtacaccttaaatggcctactatgtatatgaaatacctttgtagtcttttcatcttagaactgtatggcaatttttatttttatcccataatacaacagtttaatgttttgcaagaatttcacctccctacaagtttctaataagactgaagctcagagaacgtataccatgttatacggaggcattacatccacctggggcttttgtggttgtaaacaaccaaaattgagagggccaagccagtaagttgataacagcttgtctctcacttgcagtttccacatttctctaccacccattcccatcatttataaaaccctatggatccttcaagtataatattgttgtcttccatccttccttttagatctccaagaccacaaccccagttcaagttctctcttgcctcactcctgtgaatcttgcctaagccctttgagcacaatgttcagtctcctccatttcaaatttatcttcctaaagcagagccaaaaacgttgctcttccaactaaacattttccttgggtacctaatgcctaaaacgtacgaaaaaattcctaaattcccaaggttctactatggaagtctgataaattggaaagaggatgggctcttggagtcagaggccttaaatctaaagctctgctcttctgctgactaaccaagtaaccacacaacatactttccccttagtagctataaatttctcaacagttaacaaaaaggcaggggagagatcatatatatatatatttgcctcatactgtggttatatgattagaaataatatatgtagaggacctacacataatcggatcacaacatgtactcaataaatggtaacaactactactactgctcctgctatgatatctactatagctactattactactactactttttaaaaatttgattccaatcaacttttaaaatcttttctcccactatttgccctcatttctaatattctggcaaaacttaattcactttctgggatatatttaaactttctaattttcttctacattcatagcctcaatcttcacccataattgaagtcaacagatcaaaaactatcttgcccacaaagctgatcatctctattgaagctattcttgtggctccttgcctttcagtgttgcaatttccatacctgttttatttgttgacccactctgtgggctgcctaggaatagtgactctgtctaacacactcttgtttctcctagagtagcttatacaacttaggaatttgagtagtacttgttgactaaagattatcttctgtagattacatctctactccttctgtcatgtgaaacaaaagcatagaccattacttctaaaatcaacctttgagcacaaactttccatcaaattaaaaggacctgaaggtttttccatctgtccctgagtgtcaagttagtacagggccaggagcatatagcatggctcctgtcttcctccctagtgttttcatgatgccatcctgcatcctagctgtctccccacaggatgagtgaatcaggagtcatctgtgctatctgagaaaacagtgactgctacacctccatcataactagtagcaaacctgattagtaaggtatagatttctttctcgcttgctcttgctttgtgtgtgtgtgtgtgtgtgtgtgtgtttgtgtgtgtgtgtgtatgtgtgtgtattaaaaagttttcatggctgggtgcagtggctcacgcctgtaatcccagcactttgggaggccaaggtgggtggatcacgaggtcaggagattgagaccatcctggctaacacggtggaaccctgtctctactaaaaatacaaaaattagctgtgcgtggtggtgggcgcctatagtcccagctactcgggaggctgaggcaggagaatggcgtgagcccgggaggcggagcttgcagtgagccaagatcacaccactgcactccagcctaggtgacagagtgagactccgcctcaaaaaaaaaaaagttttcattatgggccacgcacaatggctcatgcctataatcccagcactttgggaagccaaggcaggtggatcacttgaggtcaggagttcaagaccagcctgaccaacatggtgaaaccccatctctactaaaaatacaaaaattagctgggcatggtggtgcccgcctacaatcccagctactcgggaggctgaggcaggagaatcacttgaatgcaggaggtgaaggttgcagtgagccaagatcaaaccactgcactccagcctgggcgacagagctaaaaaagaaaaaagttttttaatatggaaatttttaaacatccagaaaagtgaagtgagaaataaaattccatgacctcttaccaagcttcaacaattatcaaaattttgctagttcctacttttttataaaattttgtcattctccactttcttttgcaaaatgaaaaacatttggacatttatttctcaaaattgtacacattgatagaattatgttaaatgcacacatatattgaaaaataaagagtcattagaaggcaaaattcctacatgttaagcaaagttctgtttggttcctttcttttttctgtttagggtgaatgctttataataagtatgttctagttcaatgatggaaatataaagtaagaaacgaaggtgaactatggaagcaaatcctaaaggactctctctgtaaactcacattgcagctctcctcgttgtcaggccggtgaggcaggatgaaggaggacacagagagagggccgtcacacttgtcggcaggctgagtgaaatccagacagctggtgatgatgctgtagtagtgagttggaacaggaatggaactgccttccacgtacctgaaacaggaaggtaaaacgaagtcacagttgatgagttgatgttgaagctttcttttttaaatggtgatcaatgaatattgcctaagtcactaaaattaatccccattcaattgaatcatttttcacttctaagcactagcccacttctatgtctttgaaaataatgttttctttgcctggaatcccctcactcctcaacctggcagagtaagaaagatattccaggcaaagaaaatggattgatctaagaattggagacaggtaatggtgaatagaccaatgcagtagaaatgaaaggctggaagcgtcaataaaagccaaattatggtgggttctgagtgccaggatatggactggggcattattatttaggtagtaatgctccattaaaggtttttgtgctagggagtgtcattcattattagttccatgtttcaggaagataactttcctagagttgtataaaatggacaggggcaagagacattagagccaggagaataatgaccctttcaagctacaatgagatgcagaacttgatacaaagaactcatttgccaaaggaagtactaaggaccgagtgctaatgatggacctagaggtataaaaaatattttcctgtagagatcagtacagaaattcataattccttgcctggttttctattatcttaattttattcattttccaaatattaaaattacgatttaactactaatttaattttggctaacagtgatcagcaataaaataaatgtgcaatttacacaaaatttctcttcagaatgactggaaaagaagtaagataatttctatcttatttatctgtatttataaaatagcaatttattctgtaattatctctaaatcacaattaaaccctcttatactctgggctgctgattgtttcatgcttgtataaaattaaataacaacattctgaatttgtcaacaaatttgttgacaaattcagaatgttgttatttaattttatacaatgaaaatacatcccaatcactctaaatcttgctttctccactagactgtggggtcccttatgagcacagataatggcttttatatgcccaacagcaccaaagagacagagacaaccagattcaatccaagtccataggcactttgctactgagaggtactgactcagaaaatctaagggattcttaagtcccacccaaataatgaagataagtgggaatggtcatcttcccattgaagagctgttgaagaaatgactaaacaaaattaaatcctttaatacatttttttcatagaataaaaaagtgcatttatttaccacaaaacccaaaattccattcccaccaccaatgcccatttaatcaaaagaattgataaattcaggctgggcacagtggctcacacctggaatcccagaactttgggaggccgaggagggtagaacacttgaggtcaggagttcaagaccagcctggccaacatggtgaaaccccgtctctgctaaaaatacaaaaattagctggatgtggtggtgcatgcctgtaatcccagttactcaggaggctgaagcaggagaatcacttgaacccaggaggcggaggttgcagtgagccgagatcacatcactgcagtccagcctgggcaacagagcaagacgccgtctcaaaaaaatatatatatatatatattgaaaaattcaaaaaacttaaggggtgtcatctcttctctagtatatgaatatttgaaaaacttcttgagtgagatcttgggacttaaaaatcacacactgagtagaaatgaaacgcttactgttttattttgtcttctgtgtcatgtaagccatcatagtcatagtcgaagattggtccacttatcacgttaactccatttctttccgaagcatatttcttcaccaataccctttggaaataattccagacccctgtgcaaagacaaaaatccaaaaatcaattattcatgaagaaaactccttactctagccaaattctctctaggatgcatgctacgagccaaatctcacaagccaagagacaagagagctgtcgtgattcatgagatgaatcaattctatggcattaccagtgtgtgtgtcatttacaaaccagcaaagggaacagtgtagagctatgaaacaatggtaggggagtttaacgtagttcaaaagtcaggaaaggatcctcccaagctgagatctgaagcatggataagtaggtggtgtttcccaggcagaacacgccaggcagagggaacagaatgtgcaaaagaggaagtatggtgtttcagagtaatgaaaataaggccttactctttcttctcgtccttcatatctcatcaatatgctagttcccaggtttaagctttacccctgacctttcctggagatccagacatgttatccaaccacctacctcctaatgcactggaatacctaatattcatgtcaagcaaaagaattttaatgttccttcctaatcctgccccaaccctcgccttctccatcataatcaatggctctggcactcacccaggtgtttgggccaaaagcctaagagtcatccttgctttctctcctagctatagacacatgtgaacaattcctgtcagtgctatcaccaaagtacatcccaattatcccaaatttgaccacctctcatcttttcactgctctatcctggtctaacttaccatcctctctgagtgagctatcacaccacaaaagactattccctgggttccctgtgaaatgcttacttcccttgtaccttgtagcccactcccccatatcgtagccagacggagccttttacaccataagtcagactgtatctttctcttgcacgcacatgcacacacacacacacaccacccatttccaacactccagattatttttcattgtaattagagtgaaatcccaactccccaccatggtctttgcctacctctgtgactttacttcctacccctttccctatcactcgcaagactttcttcctgtcccctgacttttcccctaacttatttcaggctaagcttttgcacttgctctttccttcgtttgaaaaacattcctggatctgtgcatgtctgctttctcctctataattctttctcactttcactgtcatcccctgcagagaactgccttatcctcctgcttctaatttccataatggccaaccagaggggcagaatggaaatggagaaaaacaagagaataacagaaggagacaggataggcaagcaatgggttggttctgaaatattagatcgaattcgccatgctgtcttcaacatgggtgtcatgcggttctggctgttaacccctcttccctccccttattaaaaagcacctggccatgcttctcatactgcttcaattgctcttcctgccttctgaaactctgaatggcagagcagcccacaagagccaaaataccttagataattatttgcagtcaagaaagaagccagacagtaagaaaggagttcaaacgttaacttaagcattaagaaaaaatggagaggaagagaaggaaagaaacaatgagaacagtcaaaaggccaggcctgcagaaatgtggcatgtgaaaaaaccacccccctcgtggagaacagcaagctctctatgaaaggccttctccacaccagcctcagggtggtactgtgtgttgccttgattaccatttggtcaaaaaaacacatcaataaagaataaagaaatccagagaaccctgatttgcagaaattaaatgaagctgcattctatgtaatattgtgataaatgtaactatgtgagtttctgaaatgcttctcagttgggtctgagaacaaaccaagaaatctttttaaaagcatactttaatttttcactcataagcaataaattctctttgaataaaccttcgtttactaactaggacatcaaataaacatttttttctctaaaccgtgtggcccttttcaccaatgttaagctgcggaggcccgccactgtagctgacactccacaatcgcccattcctattttgagactccctttcagccctgagagttacataacacagcctgaacctcctccatcaagttgaagcacatagaggtgcttccttttcctacctttcccataacgatttaagttctgttcactacaaatgtactgaaaggtggtaaaagctacttcataatgcttactctatctttgaacacatggatagataaaaggatggatgggtggacagggggatggatggatgaatgaggatggagacatagatgaatagttaacagaaacaaaaaatgcagtgctttcgacattggataattaagtcagaaatccatataaaccttagaggtcatgcaatcatatctcttaatttcacaaatgagagatttaatgacatttctatgatcacacagcctgtggtcacactccaggaacttggctttttgtgcccgagctcattgtgcctatacaattcttgacttcaccagcatccacaaatatttatgtcaggtacaaagaaattacaaatgttcaaagaaactaaaataattggtacaggactaaaatcatctgaaataaacactctgatgattcagaaggtcctttcggctcttgctgggtttcagggccaacattcagaaaatgttatcaccccaagaggaagaggtgctactggcttttactgcaatgctcaacaaataaatatagatgctgttaaatatcaagtggctttcaaaatatagtgaagaccctttttaaccattaagataataagtattgaaataaaaataacaaccatattagaagaaaaacacaaacttgggttagttcagtttctaccatgcatgacctgtggtcactttctgtgatatcaatttcttaattataaaccggggataaactaccagccaaccttcctcacagattcaaattttggatcaatgtagaaagtttacatgaaatcaaagtttacatcaatgtagaaagtttacatgaaagatcctcaaaaattataaaggttaaacacatgaaaagtattcttattaaaattaacagaggtagaaaaggtaaggggtaaatttagaaatgtttattttcataaataacagtgtattaggtaaatattggacttacgtttgaaagcaggatacattggaaccatattggttacaaggaatgcatcatatttagcctctggtgaagagctcagatctaaacattaggaaaacaaatagtatacgttgcttaccaaaatctatatcagttaaaaaaaaaagggagaggggggtagaattttcttaaatggtccaaacaacatgaagtaaatgaatctactcttttattcctactcctaactgcgttatacaacatgtccttactcccctcccactcagtctcttcttcactcaatagctctctcccaagagccatttacaatgtttttttcttactgtctacttcttgagtctaccaacattatgtaaaataactccttgatttcatcagtgccatttagacttaaaaaaaaatcatcaaggtaatgagagatggtttaagggcttcagatttttttttttaaatatggaatcttgctctgtcacccagggtgaagtgcagtggcctgatcacagcccactgtagcctcaatctcccagatttaagggatcctcccacctcagcctccagagtatcagggactactggcgtgtgccaccagctcagctaattttttaatttttttagagacaaggtcttgctatgttgtccaggctcatctcgaactcctggactcaagcaaccctcccatcttggcctcccaaagtgctggaattactttgggattacaatggtggctcatgcctggcctcaagcaatcttaagagatcccctctatagtattacataaacgactagtgtcttaatgattcactgtttccttttcagattctcatttaataatgtaaggcgggacacagaagattcccttgcacattagaattcccctggagaattagatttttttgaaagctagtcactttttggctgattttggaaggatcccataaaaattcatttagataatcttctgagcaccctctcttgaagaaaacccaagccactgaaattccaaataccaagattgcacaatgtgacatccctctgaaggcatcagatcttgatattcttaacttacaaggaggaaagaggaatccgtaggacatctgcttatcatttttgtaggccaaacagttctgactgaaactcggagaaacacggacatcaggccggacgcaactggtcagatggtcaggaacgctggaaacctcagcctgcacgggagtcagaggcactcagcaatgccgtggctctgttacgaacggctgaaatcaaaacccctctggcttctcctatgcttgtattctgattgatagtctgactccttttttaaattttttatctttgatagtctgacttctttttaaaagtccttagttttaagtacagtaagccacaagttttcaaactttttttaatcaacataactctctttatcaaagtcttaagaaaaacaatatagaaagcagaacataaagcagaaatcccactgttgaaataataaatagaatctcattgaagataacttataaaataacactcttacaaacaatatagatgtatctcctctaaatagactatttatctgtgtgtgtgtgtgtgtgtgtgtgtgtgtgtgtagaatgtacaagaacatacgtatgtgtacacagtacaaatcaaaataaactgtatttggggcagtagaagtgttctcctcctttgtattaaaaaattttaaacatgcctcaactgccaaataacattttctaatttgtgatatatacctatttatctcatcttcatcaaaactgaaacccccaacataaaacttttgttaaaaaacaacagggccaggcgtggtggctcatgcctgtaatcccagcactttgggaggccgaggcaggcagatcacctgaggtcaggagttcgagaccagcctgaccaacatggcaaaactccatctctactaaaaatacaaaaattagccaggtgtggtggcgtgcatctctaattccagctactcgggaggctgaggcaggagaatcacttgaacccaggaggcagaggttgcagtgagctgagatcatgccactgcactccagcctgggagacagagcaagactcggtctcaaaacattagaaaaaaaaaaaaaacagatgctgatagtgggggaggttgaaggggggtgggtgagtatgtgggaactctgcactttacactcaatcttgctgagaaataaaatgtgctcttaaaatataaagtctattaaaataaataaacaaaccttggcagtttctgtaactattgggcaatgacttaggcagagtaaaagaaaataaaagaattagtgatctaccttcaaagtttaacatattcccatggaattaccagaacattgaataaaggctaattcaaaatatcttacaataaatccaacataggatttctgtcattaagaaaaaataaaatattttctaagacaaaattctgttaagcaaggaatcattgtattaacatgaggaatgtaataaaataaaaaatataaaatccaattttctcaatgacctgtttggaaacagtatatgatgtccagagtggcattaggaatatttcactataaccactttcaaagtcagtgtgatataagatatcatatctagtccgataaagcactgcaggtcgcccatagaggaggtgtctctctaaaaaagaaaaaaaataaactgtgttaggtgcatattaaattttacatcaaatgttaaagaaatgttggaagagtcaagttacctaaaatggctagcttacttattattaatatagcaccttctccttaatttaatcaagctagttttcctaacacttttgtggttgatctgatcacctaaccatgggtcaagctttacagttatcaaaaccataatgtaaatgctgtatttacagaatgctttttttagttgtaaagaatttacaatttgtatataaaggaaacattatgtaataaattttgaaatgattcagctgaatggaaagccaataggattggatttctgtagaattaattattttgacccctgaagaggcttatcaggtacaccaatgatttaattaagaagaaggcacacattgatcattatatgcatacagcaactcaaatatgcattccttcagcataaaaagtgagtagtaatgagcatttaaagtaagcagctttgtcatacagaggaaaagtctttaggtaagaacttaaaggaacatgtatagataaaataagtgggcattcaagagggtcttctaagtacagaagagggaagttcatcagttaccaaagaactcaatgaagacccccagtgcagattcagacctccaaaggaaagctctcttcttaggaaaaaaaaaggtctgaagctttactctttgcggaagaagagatgggagttcagtatgaaaatcttcattccacactctgcaataaatacctggagcttgatctgcccactttggataggctaaagtcaaaacttccacagattcttggaaatgtggggccctacagaccaaaatatttagagactgaggcttaggcaattcacaattccttaagtgataaatttaaaaaaaaataaattcttgtactattttttctactagagaaaatcagttctgaaaaacacttattaaataatgtatacatgttgctttaattaaagtcttaccattctatgcaagtaatggagaaaagtcttcgtagaatactttgcaagaccctcccagatagaactgcggatttgagacaaagcggcccacactattacaacacaagcctgttctgggtagttcggctgctccagcattgcagtaaatgtagaagccttagttaagctgccaaatttggggacccacccctaaggattagaacataatctgacaatattaaataaatgaaatataataaacaaataaaacaccagcaaatcgtaacagtagtacttaggggcagtaaaacaacccagactttccttcaaaactcaaaccaaaccttttctaggttcaaaatttccattaatgttttccttgttttcatttctgctgcctctgaatttcctggtttcagctggaagcagaagtatcaaaattctttgagaagctattctcttttcatcatttaagttttcatggttaccacacacagtcctccaaactcaaattcaagcttggcatctaatcgattccattaggggacaataaaatagcagccatgttcccatacgcaatacccctccctagagcaaccaccaaacaaaaatcttggacaatctatagtctctactaactctggctcttcctctaaatcctcctcatttctaagcattcaacgtaacactctattccacaaaggctaatgtatttgcaacactctcttcacaattgttgttagcaacattacactatcatatatgctatttcctttctctctaccagaaataacttctccagtcttcgccaagtctgtcacctatctccttccaaatgtatccattattcttcatcatcaaacattgagcgccttggttgtgccagaccttgcgctgtagaatggaggtactgggcaaagatgattaagatagagctcttaccctcaaagagctcacaagtcaaagggagagacaaacatagcacaaataacagatgccatgtggtctgcaccatattaaagatagttacagagtgtgatgggaatgcagaggatgatgaatactggaaatggagtgaaggtggcatcaataaagtcctttaaggagcatatgaagttaaaccaggctggccccatgttacagttttatgcctgttgccctggtataattgttaatagtgtcccttttcacgctcaaaagtgtatgacaaatattcagccctcatggaagagacatgaagaagaaagggcgaggggcccaagaggggcagagatatcttaagattcattttctctgccgggcatggtggatcatgcctggaatcacaacactttgggaggcaaaggcgggtggattgcttaaggtcaggagttcaagactagctggccaacatggcaaaaccctgtctctactaaaaatacaaaaattaaccaggcacggtggtgcgcacctgtaatcccagctactagggagtctgagacaggagaatcgcttgaacccaggatgtggaggatgcagttagccaaggtcatgccactgcactccagcctaggtgacagagcgaggctccgtctcttaaaaaaaaaaaaaaaaaagattcattttctcctgaaaggtttcctcaataaagcttctccatctctactcactctactgctctacatatatagattcaacttgcttcagaaatttgggttctggccaggcatagtggctcacgcctgtaagcctagcactttgggaggctgaggtgggcagatcacttgaggtcaggagtttgagccagcctggccaacatggtgaaaccccatctctactgaaaatacaaaaattagccaggcatggtagcacacgcctgtaatcccagctacttgggaggctggggcagaactgcttgaacctgggaggcagaggatgcagtgagccaagatcgtgcgactgcactccagcctgggcaacagtgcaagactctgtctcagaaaaaaaagaaaagaaaagaaagaaatttgagttccatagcttccaagctattgtcataactgcaagttttggcacacagctggaacacaaaagtatcactgactgcctttttctcaattattactgagcaaaaatagcataataaggggaaaaaatacagtggtttttacagcctcctaaaaatccaaccaaggtccccaatgacccaaaaaaatctacttgggtcttcctggagcttaacagtttcatctaagaaagagggggaaataatctctgcagtaagaaacacagattttaaggtccagaatcaaaatttagattttattttttcagtttatcaaagtatcaaagaatcacagattcagagtcatagcctgactctcctagtctttatgacatcttgggggagccacccactgcatttttgttgagcaaaaagtctctctactcaggccacaaaatgtacttgaatcttgttctcggcacacattgagatctttatctcgagaccagcaaccctggagactagcctgcaagcctctgcttctgcaatatgtttctgggatttcttcacgtggatctagtataacctggtcttcccaggctgagaatgcctgtcatggaattccagaccgagccttcattccacaccccagttccctgtttacaatagtgtctctggcagttttggtacatgccaaggttctcctccagataccacacttggcaaaatactgtgaggccaatctttttaagtggtgtggacttccccagcactcattctttttgtattccaaatttgggtcgtagagactggagtttgtgttccttttccctcctcagcttcctgattcagattcccacagatgagcaggctgtcttgagagccacatgaaaatctctcctcttttttgtttttttaaaacatacactcccacaataatatgctcttaaatcttaccacaaaatctctacccaagatctttccttttcttgcatactttctcctttgccttacaagtgcctattatcatttgctgccatttcaacctcctctgagatttgatttaaggcctctctttagtgccctgttctttcttaccccaaccttgaaaacattatgctgtaatgtatcaactggataaatcctacaacagaacaataactttatgaggacaaggacttcatctgttttactcaccactgtatcttccatctccaacaatgcccatcacataatatctacttggcaaacacttgttggtaagttaatgatacatattttttttaaatcttggctttctacatatgacctgtctaatgttaccctgaaaggtacactgggcaggtcagtagtatcatctccaacttactgatgaaggaactggaggtttatgatttgcacaaaataattcagctgcatagcagcactagaatcccaggccattactcttctgcttggccttttgggtggtctccagttgggtgctggccgctgggttatttcatggagagtgtatgggaaagaagatccaactacttcccggcaggaactctgcccgagtaatgcctactgagaagctaatgaggacagtagtttctgtcaaagcatctagtatttcagaagcaacttccaaactttgatatacaaattttttgttgagcaaagagtctctctacttaggccacaaaatgtatatgaaaagcaaaattttcttttgacatattccctttgttcccactcttagaataagaagcattttcagatgaaagcacatgggcttcagtgtcatataaaactgcgttcaaatctaatctcagctctttatagttgtggtactctgtaacttaatctcccaaagctttatatctccctggaatgttgcactgtttacaggcaaaatatgtgaagtggcttgtttagttttaacccaaagtaactgcagttgtagcagttgcagttgtactgtttagtaaaggtatgggctctacctcaatactggcaaagaatattgctaggtaaaagttgttaaaattcaatctaccatcaaattcatcttgaattctactataaacaataaacaattactatgtattgatttcttccaagtattcccaaaaacacacagatacacacgcagacacaaacactcagaagcaggagtgaatgctatctccttctttctctagaacaactaatatctccaaagaaataacacaaatgagaaacattccagaattgacaagagctaaagaagatgttccctctgtagccatattcaggactctgctttaaagttaacaagaattactagtgtttaagtcaattttctttttcttttttgaaacagagtttcactcttgttgcccaggctggagtacaatggcgagatctcgactcactgcacctccacctcctgggttcaagcgattctcctgccccagtctccctagtagctgggattacaggtggatgccacgatgcccagctaatttttgtattcttagtagagatggggtttcaccatgttggtcaggctggttttgaactcttgacctcaggtgatccacccacctcggcctcccaaagtcctgggattacaagtgtgagccactgaccgcacccagctgtgtttaagtcattttcctatccaaactaacttctcattgtgtatgataaggagccaagtatacataggtgttaaaattatttttaattcctttttcacaaagatgatggtgagggctaacctaagaaaatatgaaacatttttatagcaatgtaaatagagtaaagaccaaggtgaaaataaatggtgcaattattcttgcagtgaaaattatacttggctatagtgccagaattgcttgctacaagagattttttaaattttcttttcattcattaattcatccatcaattcaatgccacaaggaaatgagttttcattgcatggaaagtcggccaagacattaggtatatgagatccagaaataacaacaggcatgcaattaagacctggagtctaccacctatctagaaatattaaagtttagcaagcagcttagatggccatttttgaggattacatttttctttctctttattttagtaaaggatttgattccataacagtttaaatatttatagcaaaatattgcccaagattggtttaacatacctcttttttatcacagatatccctgtgatcgtttcactattggaacatgcagcttttactcatgtattttgtacagatgtatgacagattttacagcatatgccattaaaacagtcacatataaatgttacaggtgaagtgtgtatagctcatgacatattctgaaaaatatcaactacttacatctgtgttttaaaaaactaataataaaaatagtacaactttacatctgtatagaagtttaggtttacaaactactttaaaagccttcatatgtattcaaaggtacctagaaaggggaagtaattgccctgaacataatacatgtgtgctcacatacatggtggttcacattcacaaggatctcctccagtagggcagacactgaatattttaaatgggaggccaaatttatgacacaggaaacaccataaaggcctgaaagaactcagaccaagaaaacatcgctttgccactgaagaaatgaccaagatagagcccaaaaggaaacaaagcccaagagacagcgataggagagagcaacaggagaaagagcattgaggtttatacatattccagcatctaagcaaggaaatgcattgcacataataagacaaatatttttgaaggctctcttgtgtcattaaatgttggtgccactaggccatgagcagacttagaatagcatgagctattctagattcccccctaatattttatgccaccactttgaagccatgaattagaaactctcagtggtacagttgtgtcagagtaaccagtgccagcccagtgtcagtattcaacaaatgcttgctgaatgtatccatgagggtttgtttccatgaaaatacacaaactttaagcttcagcggtataaaaagacacttcagggatttaagtaagaaactcacgttccactcagagcagagcaatggagatgtaaccttactaactatagctccttatagccctgagagtcagtgattcactaagaagatgtgtcttatttttatgctcttaagtttgaggtgattgtgtgtgtttttttgttgttgttgttgtttgtttgtttgtgagacagtctcgctctgtcgcccaggttgcagtgcagtggtgcgatctcagctcactgcaacctctgcctcccaggttcaaacaattctcctgcctcagtctcccacgtagctgggattacaggcacgcgccactgccgcccggctaatttttgtatttttttagtagagaaggggtttcaccatgttagccaggctggtctcaaactcctgacctcaggtaatccacctgcctcagcctcctagagtgctgggattacaggcatgagccactgtgcccggctgaggttattgtttataatgaattgtgagactggttttgtcatataaggacactgccaccaacaaattaaatgcaggaatgtttttctcagacagaaatgctttagtaccatgaacagtcagactttgaatcagcaaaatcatgggagttcaatagaagttaccataattaatttcattagtgacttttagaagagaagcatctgagtagtatttatctgccttggcaactaaatatctaaaaaacttgaatcatgagactccccatcttttgactctagcaatgttctaattgttctaattataatgacactatagtccactagaggttaggtgtcgaacattgcaaatcacttgtagagtttgtgaaagatttgtgtgccttctaccaacaatggcctatcttcaaagtgagattcattccgttctgtgccagagtctgtgtgttctgtgatcaaagggagaagtgggatgatggagatacagaaaaggaagaaggaggcagatgaagatctttaaaagaggaaaaataagtcaagtaaatcaaatcttctaccggtttcctcaactctacttaatcagattggaaagagcatatatgataaacagaaccatatgtaagctaataactcaagcgatgctctcaggagaatttgaccacgtgcatctttgctgcatgacttgtggctgctatgcttgaattctttctgcattttccatacacttttagtcatttcctggctgtttcaacatgttatcccatctactttagtaacatgtataggaggcttcccctccccttctattttcctccaattttgtgaaacttcacaatcagataaaaagagcctgcatggtagattgtgttattgctcctcattatttactgcctccacccattgccatatgacttgcaggatagagtccccgtggaaaaaatgtacttccctacaccattggtatcatgtgctcagctttggccagcaaactgtgaatggagtgacatatgcctcataaaagcagaagcattaagacacagtgcacagttctgccactcttttccctctgtcaagagcaggacatgtctctgatgaaggctactccttcagcctgggttccagaataaagaatacacatggagcaaagctgcccttggcctacagccagcacactaaaatgggagcgagaaacgcctcttagtacaaatcactaatttttttttttttggtcatatcataagcttgcgaaagttcactaatacgtgctcgttatcattgtacgtaaagtaagagttagggcttgagatgatccttcatatgaggagggagttctgatttgattccttcggtgaatctctccctatcacaatatatatatatctatatatacactgactctcgaggtagataccttcaggataggcaccagctgctattatttatcattgtgactatcattccctttataggagtgccccacagtgtcttatgactcatcagatacaaaatggattgtgtacttttcagagggcttaaaagctattgaggggggagaaaagctattggaatttttttattacacagctggcatcttgtgtacatggaataaacaaatatcctttgccagataggtatgaaagtcactttgaaatacaaattctaattttaaacaatattgtgcttacactataatgtaaataagaagccttttcgattttcgaaaacgagaaaaaccttatctgattattttgcaaccaccccttaccttctgtagacccttttgtatgaagccgtttgttgagttcatccaacttgttcttcatgtgtgaaaaccagtaaaggaaaaaagaaagcaaatcagaaatgttctttccctctgtgcccttctgtcgacttagcaccctgctaaattcaaaagcgaactctaaactccatctatatcatacattctttcgaggaattaactgttttctctcaaactgacattctgggctccacctctagcagttctatgtttgtaagcaccttcttcaatctctgtttccttccttaaaactgtggatagtcaccacagtaccaatttcccatgtgggtactgatgatgacttgggcatatatgtgtaagtaaattaggatagcgcctaaatgtttcagattaatctctaggcacactgaagtgattcccaaactaatttatgaaatcacttttcaccaaagctaaaacgtaatgactcagcaattctgaaacagcatgagtcagcaactctacccttcactgtataccctagcatatgcgtgcaagaagacatttccagtaatgtctgtggcaacattgttgtaagagctaacatttgcaaattactaaatgttctcaagtaggaaaatggaaaaaaattcttatggtacatttatacaattaaatattaactactgtattagcagtaaaaataagtgagctaaaacttcatgtactaatatacattaagtctcaaaaacataatgataaaataattgcaggatacatatagtataatagcatttattaaaaattttacaacatgcaaaactatagtataggttattttaggaaactatacaaaagattacttcatacgttatttaataaatatataaggccaggcacagtggctcacgcctgtaatctcaacatattgggaggccaaggcgggtggatcagctgagtcaggagttgaagaccagcctggccaacatagtgaaaccccgtctctactaaaactacaaaaattatccaggcatggtggcaggagcctgtaatcccagctactcaggaggctgaggcaggagaataacttgaactcaggaggcagaggttgcagtaagccgagatcacactactgcactccagcctgggcaacagagcgagactccatctcaaaaaaaaaaaaaaaaaagaaaacctgtccaagcatagtgtgtgggggtagtctctgtttgcaccaccaccgcatccttgttgcaccctcccacaccctgctctgtggcctgggaggctgacctctagggatggcatcaaagagcaaacttgccctgtggctccctgttgggctctaccaaggggaaacatgtgaaaggaagtacaggggaggaagatgacggtagcactctcctatctgggagtgctccctgctgggttgcaatgaacaagctgcactcatcggccaaatacaatagttccttcctattcggttgtctctccatgttttggaaacttactccttcccctcaccctttaaaccttagaaggtactatgcgaaccccagggcacttcgtcactcctcattgaattccatccaccctgctcagccttggtaaattactcattaaacatgactgaaacaattcctttaaactctctctttttttcatttccttttttttttttttgagtcagagtctcactccgtcttccaggctggagtgtggtgacacaatcccggctcactgcaacctctgcctcaagcgattctcccacctcagcctcccagcgccaccatgcccggctaatttttttgtgtttttagtagagacagggtttcaccatgttgaccaagctggtctggaactcctgacctcaattcatccacccatctcagcctcccaaagtgctgggattataggcgtgagccaccatacctggcctaaactctctttcaaaacctcttctatatgggccacctgtctcccgtcgggaccatgactaatagacatgtgatccacagttgaagaaaacagaaaaagattttggttgagaactgtgactgcacagaatagcaacatgaattctactttttgtctttcatggtctatacctgtgctattcaatatggtagccacaagccacatagggctctttaattataaagtaatgaaataaaaatttgagttcctcagtcacactagccagtagctaccattttggacagcataattatagaccatgtccattgtcacagaaagttctatgggccagcactgttagccacccaacaaacttctccataataaacataaagattatttctacctttggctctaccttatcatcacaagtgcagcccaggtcaaaatcagactgaaggtacataatccctggataattgggtctggtaacttcctctggcatggttggcctgaaggtattagtgcgcaggagatgattcaaacttccatgggtcccattattaggagctggcttcaatcccaggagatctaatgaaaattaagaaaaggaggcaggtgcttcttatatttttttgatgagatatggtaagatttaaaacccttcaccttctatgggtctgaaaactgtgaacacaaatcagaactggacaaaaccaaatgtagatggcaggcaccccctccttacctcctgaaccattctggactaactacatcttgccacagctttctgaaatacccaagttcattgcctgaccatgaatagagagagagagattcccagaaagaaagagtgaaggaacaagactttgattaactattgcctgtatctgcgatagttacaacccaagggtgatcaatgtcagtatcactttttcctgcacttctctgggactatttaattccatgttttgaaatgagacttataatcaataactaactagaagtctgccctctaatgactccacagaagtgtggggacatgaggaggctttggccctgtcccctgaagtgccactgagcaatgaacaggctgatttcatagcaagtgaatggttgccaagtgcgtattcagtaacttgcttgagctcagaggcaggacaggggacagctagcagccaagatgggaaaagaacccaggagacccgacttgcagactccccctctaaccaccagactggcactcccttactaaataggaaaagttgtcctcattcagcaactagaagttcaaggaagaaaaataattaagagcacataaatagctggccaggatgcaagctggcaacatttttaactgggctgcaatgcaagagatggaggtggaggggactctgtgcagaactcttgcttcatcaggtctctgaccagtggtgtcaaactgtaatgctatgttagaccagccagaggctgccaacagcaacactatgaaaacgccccattagtcaactgttgaaggaagacaaagaagccttagaaggggataatattctgtctttgaaccaatgggcaagttacaaccttttgtggggaagaggaggtagtcccagaaaatagacacctcatttctttctctgacattgagaaagatcatatatactaactaaagattgtttcaatggttctgattaaatgagtgacttaccacacataacattgtaaagttcaatgttttcaaatggaggcactttagtcttgtacttaaatgttgagccataacctacaaaaacagtcttccaaaagaaaagaaaaacaaaaacagttaagcattgttaggtaggaacccttcctctatttatgaatactgtacaacttcactcacaccaccattacttatcctttcgaagaaccactaaaacacaatttcaattcacagttctgccatcatacctgcatgctgttgaccttgttatcaaatccgtggtctccctggaaaaagcattttcctgatggtttcttataaacatccaaaggtttcctaaattgaaacaatttcatgattagttagaatttctcatgaaattactttgataaaaaggtaatttcagggtacaaagaatatctaagaaggggcttttgaaagtttgcctctattttaattgcattcttcttgtgatgatgaaaagaggatcctatgcatttctccaagtgacttttctttgacagttattgcaggataaatggcgacctgtgaactgaagtcacgatgccctccttggagctcgtgcttacaccaagtagggcacttgtcaaaagtcatgctctgcctgtctaggtgcttcgctagctctgagactgtaagattctcgactctaggaccatgtttgtctggttcacttctatgtacccctccctagggtcagtgtcaagacatagttggcactttaaaaaaatgtgatgtctcacctattatatacccataataatttaaaatttaaaataaaataaatttgcgatgtttaaacaatgaatggagatctatattctataaaaatatttgcatgcaaatttatctatcaatatacaatacaactagagtacaactaagcagccaacttaacagtaatcatgacatatctgacaaaagcatggtctcacctagacaatatctctatttagaaacagaaaacagaaatactgctctctagacatcaagaccatctgatctttccttttgtgacagaagacaccttttgcaaaagtgtcatgtgacccttttccaaaatagctttcatgttaatttaatacaaatatttcctaagtacctatgggtatatagcactgaaagtgctttgggaaaacaaaaaatctaacatacgggtctccacccttggaaaaataagggcttgggataataagacatatgcatacaatacctcaacaatgcaagatgagttaaatttaaaagatgcattgttaaccaacatgcctggttttgggctacactaatttgcccaactgtcatcatctttcacttaacttctactcagctcccatgtttttgccatatgaacctactacctgcgccagtgtgaccccttccaagctgccccatacataaaaggtccttcaggagcacataccgggccaattaatttcagtcacatcccaattaatttaccaggccagtaaattctccatgaggatttcccacaactgttttagaagactccaataattcctgttcttcgtacatctttcttcataatcccacatatctaactctaagtacaccctggaaaattacagcatgatatttatgtatctgtcaaatgtgtctctctaaacatcccatactgatacaagtttctagagttctaagttcttcttagaacttgagtttctaaatattttcttgttatcttctttctcttgcaaactagtacccagctagagtacatgtggcagttgttcaattattgagatagacaaattcacagcacttttcttaagtagaaagttggagcaagagtgagtgggaacagctacttccaggtctgtgtgaaaatggataaatccttaataattaactcattggaagttgttagagcctccagacatgtcctagaccacattcaaaagcaaggaacattctcttcaacattggagagtgttttgtagttcaatagaaggcaaacattgggaatatttaaagcaatgtaaaaagtgcccacaataacagagtttttaacattaacaacattttctaaagtcctctataaatattgctacaagcaaagtctcaacaaccgagatcaaatcagcccaatatactaaggcaagctcccatttatacttttgacttactcaagtagtaagaatagagtttagaatgtaaattcaaaggatgaaagagacacacacacacacacacacacacacacacacacagatgcactgacagactgcaaagagacaccacaatgctgagacccagaacatagagatatattgtctcagcactgatggtttatgtagcccacaaaatctttggaaacagtgagatttccaactgatatttctttcagtgatgactaaggatgataaaatatttccagttgccaaaggggtggttgtggaaatgagaaacagaaatagcccatataccagttaccttgcaacatgccatctgcgttccaccaataaatggatatcctcaattcttctgttgttggcatagtgcaaacgtttgggaaggtgctgtttcaagtaaggcttaaagtgctgatctggttttttacactgaaatagaaatggaaatcagacttcagatggaatgtcttttggaaaaattcttacaaattctctctctagaaagctgaaggagattttaagcctaaccaaaggttaatgagtgaataaatgaaatttatttctattaaataatgtatgctgaaaacaaatagattcaaaagagattaagtaaccttggagatgatatgacaggctatctgaggacagttaggaattttaagatgcattcctggcttgtgagaccatcgctaagagcaattcacactccaaggcctttcccaactccttcaagtcaagcagttgggggtggggtgtcggtgggaggggaggagcacatgggtttaggcttatctgattagatgctcttgtaccactaaggtcgctacccagcatccgggaacaatggagcagagtgggtgggcagttctggttcagggaaagtaaagatttgtttaaccatgaatgaatacttttcagttctaatggaaggatcagatattctccatttgtatcattgccaagaccattagggagcctgcagctgaccacaggccagaagttttgaaagttcttaaggaaacaaatatacaggatggcagggcagtgaggaaagtgttcctcccacccctccccgccgggggaggcacacacaggagggaggctgctccaggggcagaggcctgggcagggcagaggcgggacaactggaaacacttaccgtgagattggcaataatggctttggggtcatctgttcaaagagaggagaaagatttcaaaagaaataacaaccattaccaagagaaatcatttttgcagcaagatactcaattctttctccttccatcccacagaagactatcactttagtgttttgtttgaaagataaataattgtgtaggggtatttaacatttcagtcattgacatgcagctaagcaagtggaacaaatcctatagtaaactgccctcctaggtccagttctgctcttctggagggaattcctccttccatagcaccaggatactgctaggtaaattgcttcttgttttaagttccccctaatggttccccttgagacataatttatttgcagtttgacctcaggaactaaactgggcatttggggcttttaatgtaacttcttatttatctgcagatttttgaaacaagtcttcacccactttaagttgaaacttctaatccattgagttatttttttaaaagggagtttgtttccctatttatatcctgggtgtaattacacaggtagccgcacctctccagccatagacacacacgtgcatgcacctcctttattttcaatagcatcaagtaaaagattttagtcaatactctgaactagctaaaagcaaaattatgtaaatgatggctgtgcataaactgtggacaggattatattatctgaagctccccttttgggcggaatgtggggagaaagaggagattgtaggttgcttggattttgttttgttttcaggaagtttgcttcagtatgttattacagaatcagcagaaaaggaaagtggtgttcagaagagatagcaactatcatgaggcagccctccctggcatctaaataccagtggagcaggccttatctgtatcacgtgctgctgcatccctgggcctgttcagagtagacactcaatatacatttgttaataaatatttgttcatatttgttaaaaatgtatgaataaacttgccttgggatataaatatacagactccaaagtctattttcagaatcttagctctaaagcttgaaatccgaaactaaaatgtgtattccattggccttaattacatctcttactagaaggcaaataagtaataatgtaataataatagcccgaatagatttcatactatgtgcctgtctttctataagagctctgcaggtggccagatacagtgatgcctgtaatcccagcactttgagaggcaggggtgggtggatcacaagttcaggagatcgagaccatcctggctaacatggtgaaatcccgtctctactaaaaatacaaaaaattagccaggcttggtggcatgtgcctgtagtcccagctacttgggaagctgaggcaggagaattgcttgaacccaggaggcagaggttgcagtgagccaagatggagccactgcactccagcctgggcgacagaacaaaactccgcctcaaaaaaaaaaaaaaaaaaaaaaaagagctttgcaggcactttctctctggtcattcacaataaccctaggaggtaaatgctgttcaaatcctcactaagccaatgggttttcagaaggaggaggagttggcactctgacactcaagcaacctgattgagcaagccaggcctcataaatcatattcctcaaagggacgaaataaagtaagttcatggtctttgacaatgaagagaagtaaatagcatgtactcagataagtcccagagaattactaggaatatccaatgcctgagtccatactggggacatcaatccttcaattctgaagaacttagtctttgcaggctaacagtcctcattttgtgtgaagaaagggcagtggttcagctaatctggcttcaaatctcagatctgaaacttactaaccatcatcctcgaagctagttccctcacccctctctgagcctcaatttctactgtctataaaagggatagtgatacttatcacacaatgctattaaaaggattaaataagagtgtatgtgtatgtgtgtgtgtctctatctgaaatagtggtatgactaagacatcatcatcatatccaacctttatatagctttgactatgtgctaagcactgatctaaattatgtaaacacaatctcttgtttaatcttcctaacaatccttaccttgcagatgaggaagcagaggtacagggcgtcacatggtgagtaccgagcagagctgagatatgaacccagacatctgtgcctgtcaccaccccatgctactgtctcccacaaaatgaaaccacattggaaagtgtttttgtaaagtacaaaaatttttatcattgatagttatgaattcatgggccatgggaaggtttttttttctcctccaaaccaacctccccattacatgtactaatgtcagaaatattgttaaaaatagagaaaatcttttttgcatagccctgaagtgcaaatactaaaatcgaggggtgccatagtgactgcatccagtctatgcgagggcagaaaagggaggacacagggacaggaaaggtcatggaggagagagggcagaaacacccacattttgtttatttcacaacatggtctggagctgaccctggaacagttccagttgtgttgactcaggaacataattagggaaaaacttaattttccaaagctgtaaggttggtgtcaatggtttcttattcccaaggctaaaaactctaaagaatttttttttcaaagtgcggcataaccccaataaaactatggacttctcaaaagctaggtagacagcacctaaaaatcttagtccacaaattaagtttgtatcagtggtagatcataacctgaacatgtaaaacataagtgacaagattattcctgtttatttttatttctaatctttcaggacagctgccacttcccaagggcttaatatcttttcctactaggttctaccaatcacttttacaaagagaatggactccattccacaaggctcctaggaacccccacagtccaaatgtggttctgccaacccttacatagaccctctagtttcatctataaaaatgatcagcctgaacttcttattgaaaaaattcttatcttataaacttctgtttatggtcatgaatatgcttcaaactaagtgcaatttccacataataagaataagagcaaatatttatataatgctactatgtgccaggaaccactctaagcaatatgcatagattaatttctacaggtagctgctagcatttatcatccccatttttcagatgaaaaaactgaggcttagagtctaaatgacttatttaaggtcactcagctaagcggtagcagagccagaatttttacccaagtatttcagctttagaaaacaagcccttacctattcctttgtattaccactctaaccacttaatattttaagaatcaacttacatttagcattgttgctaaatttggatcgaattcttcctagagttccaggcactaaagtaatatcatccacattagttaggtaattactcaagaactcagttctatcacatgtgacatcttccattcctatggggagggagaaaaagaatattttcaggcaagactaaaacgaaaatcttaacatagacacgaaagataacatccaggcatctctttagttagtttttagtaacttaatgggaagagccctgacttttgagatttttgtatttgactttaaatggtttaaggcttctctgtataatcttttctctagacttttacttagccatatcatcttgcaagcactagaaggttgaaagtgcattacctcgattacattttaagtcactcagccagaatagcaagacaaaggaagtcaccatgatttaaacaacaacaacaacaaacataactattgacagagtctttatgaaaaagatctattctttaaaaaaaaaaaaaaaaaaaaaccctaggttgcatcaaactcttcccagctgggggtggtataaatggaatatacagttctgtgtctcttttacaaaatgtcattttccaactctctaatatatctcctgtcttgagtacataatcaccagtcctcactgtctccactggtggccttggatgttactgacaaaacaatactggcaacaagagatgagaaagaaaaatgtcagttccaatgaccacccaaactgaaaaacaaaataacactgaaaacaagttgtaaacaatgtaattagtcagaactgaaagctagcaactaaagcaagaaggttctaggtagggaatttttttaaacaacaaatatttctcctccaccccaagatttgttgtgtgtccccatcaaggaaaattcttttattaaaatgcttttatttaaaacattgttgtaaactcaaatcttagcatcatagactatggaggctactagagatcttattgaaatgtatgagatgacctggaacgttttaatatattgctcagtacaattcagtatgtacatattctctaacagggaaaataaccctgttggagaatactcatatatttatatcctgtaaaggatgcccaaaggttttaaaataaggaaatacaacccagagtaccccagatctggtaaaatttaactaatcacctcctaggatcccagatccagaaccttcccttgtttaatacaaattggaatgaaatgcaagaaaaaacacacagcataaggattatatatcttgcactttaacagttaaacccttaggaagaaaaatagagcaatgaagagctactatgttttagtacaatgttagcgtgggaagggaaagtccccaaatacctattaatagagggctgaaagtctttcccatttgttatatttctaggaagtcccttatgccaccccaaatgtgagcaatctcctttacttttgaagtccatcaggcactatgctaagtgctcctcaagcgtcatcagccttcactctgcagactaactttgtggaggggtgttaatgttctcacctgacagatgaggaaactgagacttgccacaaaaggtgtatagtgtcagatagctgttaaatgacacagtgcaatttgaactccactaaaattcattatgactccaaagaccatgccctaaaacactaaaccataccatcttttaagagagaggtgctgtacactttgggaggccaaggcaggcagatcacctgaggccaggacttcgagaccggcctggccaacatggtgaaagcccatgtctactaaaaatacaaaatttagccgggcctggtggcaggtgcctgtaatcccagctactcaggaggctgaggcaggagaatcacttgaacccgggaggtggaggttgcagtgagccaagattgcaccattgcattccatcttgggcgatgagagtgaaactccacctcaaaaaaaaaaaaaaaaaaaaaaaagaagaagaagaagtgctgtagttgtcccaaaccaaatggatctactcatcttggaagcctacacactgacaagccaaggttttaacctatccatgacctttacaatgcctcagcacatatcattgggacccttctacttagatgtctggctccagcatgtgagcaaatgctcttgacacctctgggcaacttaaattgaatcagctgtgacacatgctccaacttctctgacctgtgtgtagctctccactaagccgaatgcatggagcatgacttcgcaaagggttatatctagcccactcaagaggagaaagctaatccctttggcttttttttttttttttttttttttttttctaatttctcatagatcttctaggacattctggaaagaccttcaggaccagagctagggagatttgcctaccattcttaacagaactgccaaagagtcagccaattttcatcctccgaactccactagaagggagaagccccaaattccaatgctactgtttcaatctaatagttccggaatacaggagataccctttagaactcagtctgcatgtctctgagcccccaccccctgcacagctctacagtcatataatgtttatgatgctcttgatctcctcaaagaattgatcataaatttttctacttcataaagtgggatttagaaaaactacttcctataatgcttcttcctctctttaacagtcatctgaattacagcagggccttccggtttggaccttgacttccctcagtggattcggggaaatgatttgacttacacgccacttctttgacaagaatcccatatctctgcttctttatcatatttagatgtattttttaaccatataaactccatgggctcgttttggggatgtggctggcagggataggagattatcacctgatatgtcacattcacagaagaagctattaatgtcacaaggaaactgtctgtgttgctttaaagagagacagatttttgtagaaaggtctttcctgcaaataacagaaatatataagaagtcccagcttttgatcaaaatgaacccagggatctctcaggtcatctcatacttttcaatcatggcctgatttctatccccatcttaaagaaagcggggatgaggttaagaatggagtcttggcttctaagggcaaggattcttttcctcaatatgatcagaaacattatccatctatcctattagcaaagaaaaaacaaagctttaccatggtctccgacaaagatgacgttgacacaccgatgcagttttagttgtttcagtccatccattaattgccccacaattttgtcgatttccctcagaggatttgtcatctaggaaaaagaagcaagttagtccccacagggttttctttctttccctttcagtctctcatagatcttctacccctagaacattttggaaagaaaacttccggcccagaggcagagctttgtctggggagatttgcctgccattcttaatgaaatctggtctaagcacgttatatttgtattcttttgacagaattaaaacctctcctcatccaatccctttaaagattctttgatataaaaatgtcaaaaatattgttaatgaaaattctttaagagagaaaatcgactttctaatatgtgacagcatcctttaaatccaagagttttgagagtaaacagaaagtccctaagtgaaatcacattagattttgaactatggcaagaagatagacgctaagtgaattcaaagctgttctgaggttaaaatcacaacgttgcactggataataaattagaatatcattaatacaatgagatccatcttgttctaagtaatttaactgttggcatctgaaagcaatagattcttaacagaagaacctattctaagaaacaagttattgcttctcactttagttcttttaaagctgattttgagtgaaacaagaatctataagagtcctaacttaaaaagaagtgaaccatgagtttgttctagaaggtttcttctttaacaaaatatgaaaactcaattcttttctgaagaccatttccaaagcctaaaaaacattacccatatctcattttcttacttcaaatggaagtttctaacagcatgaatgtcctcacatactagaggctctccatccccctttcatctttagctgtgcaatggaaagatttttaagaaacatctgatcagacaaagaatagaaagatacagggagtatatttagatgaattttatagcttagctaacaatcacataaatatacccaagatgattaagataagaacagaaaggatgtgaatatcatttttactcggacacataatattatcttccactagcatcttctcagatgaatcaagacctttcctcctgttatttcattgggaaatcaggtgtaaacttttgtttttttcttcatgacgggagtcagtatttcaagtcctatcccaaggaggaagccacagttgaaagtttcagaaagacatgtgcagaataatcggaagggactaacgggtgtggaacaaagtggtatttgcttctgagaaaatcatgctctgctccaagatctctgtctaggtaaagaaataccaaatgaacaatgtgttttgatctttggcaatgacttattttcctttactcagcaggatgactcaggtaaaatccagaacctacttcttagggatcagttcagaggatcacaaataagatactgcctcagaggtattcaaaggttttaggaaaagcaacaaccgataggctcttctgaacatactgggaagagtagacattacttgtggaaattacatacaactctatccgcccattattttctctttctttctgtcttagctatttccttctctataacctacaccttttctgatctctgaaggtacagacccctaatctaagccaacttcctattgagttctaatccacattgtctttgagaatacctccttttaccttgcagggttgttctcaagaaccagggccacaaaccatgtgactgattctgtgaataagtgcactcttaatagtcactccagcctaaatgttaatactagttttagggcaactaactcttaaaaaaaggaaaagacttctttttttcctgtcatgttgagttcaggcagtcttcacatcagtgttaacctctgaagtaccacattcttctggactcaaagccaaggtcaatgcaccagagtttttctaaaacttgctcagccgattttccaaccaaggcactgaaggcaaccttcaactcagacctgcccgccacaaagctttggaacaatagataaacttactttgtcctgacgagtttccgcagcataatgatccatcctatgtatttttcttcttcttttctttggaggagcaactggtctttcctgtctcctcttaggggcaactttcctcttaggtctcttagccggagtaaaaggtgagccataactactctcctgtactggcggatagagatgtctggactcagaagtcgtctgtccctctgagtcagatataaagcttacactttcccatctgggatcagcagagtctcagaataactaaggctccttaagtgagaaaaaattggaatgagggatggatgattagaggaactctatggagagaagcctcctaaattgatgttgatactgttgtcacagcttcttcgctgagaacaagaatccaatttaagaaaatctagtcatgtgggtttcttttggctgatatttatggatgtatgggaaggtggcattagacaagctctgtattccataactcctgcattagggagagactggtctttggttatgaaaagctctccatttataaagaactaactgaaaagtaggctaaatactagccacttggtcatttcaagaggacaatgaggttcatgtaagtgattccaattcagaatctgacagttatctttctgttcacgtcagcaactatgtcaaagcaactgtcaccttcattggcaaggatccagtgaaaaattttaaaaccaaggacggaatgaaacataaataataagtaatcctccttaatcataaacgtactcccacaaatcaggactttcagcaggagagagaactcactgacaattaaggttttcagtacagaggaactctaagttaaagtccttttaaaattaggtaaaatctaaaaagtcatcaaaaagtcatctcttttttgtcttggtatatacagaccaagaaagagtctccttatgctcttgctatcagaaacctgcttttaaggggcgttgcatgctatgggttttgttttgaaaatccagagagcagtgaagttgacacataaactgaagataaccttttgggatttccaaatgctggaggaaaaacaggcccctgatttgctgatggtgcaaaggtgaattaaagcagcaagccttgctgtctacctcactgacttctctcggagggtgggtggggggaatgtcttgagagccattcagatgcaggaaggggcgggaggaggaacaatgttagtgtatccaagaaggggaacatctgccatgcgatttcactgtttccagggcaagccatggcaaaggcacttctgtttctgtctcatcctctctctccaccaaagcaatcaaaagacacagccccaaagactttggttttgtttgtttgttttttaatgctcctagttttaggcaaatctccataagaaaagcagcaaaaggaaaagaggattttccgtttcatggtcactgaatacattctgctagcgctcaagtcggcccatcaaactctatgccatttgcaagagacctcaacattccaaagactccaaagatgagcccttccaattgcagcaggttagaggagcagaagagtagggtttagtcaaactgggttttcatccagtgattatatcgcatgtatttccttcttcaaatgttagaggtacatgaaagctaagttttcactgaccagccatactttagcctgaatttagaaattttagcctgaggttattaagaggatgggaggtagaggtgcaaatttccctgcatttcaggatactttgccatctgaaggtagagactagccagccaaagctctgcctgtaggcccggaagagcagccgaacaaggggtcacagaaaaagcatagaaggtcaaaaagaaaaagattgcgccaataatcaaaagcaagcatatttttgaacattcaccattacactctgaaaccaggagcaatacaccatttcttgaactattaactcaatgtttggtcatctcatttaatagcttttgagaatcattctgaaaaaatgtggactcaaatatttagcaaataaagcacaaatttcaactgaattcatcttattgtagcatatagcattttggtagttaaaatcatttcaatgaaatttcaaatataggttattttcttatatgtaaaagatacgttactgattttaaaataatctttcaactagtatgttataatcttttcatgtataataagtgtaaatgatgatatataggtaggcatataggatacacaggtgtataaaccaattagcctacaatagaagagaatttttgctgacttgctttggtttcatgttttaaaagcataaactattttgtttttcattcagttaaaataagattcctagaaccagatgagaaataattgaaatctgaaaatatcctttgccttatgagaagaaaatgaccaggttatcagattaccattactgaagatatactccaagatacccaattaagagtttatccagtaggcatatgaaaataccctagctgcaagaagtagtaatactgaaaaaaacataacatgaatactttcaactcttaattcaaaggtactataggaaaaatctctgtttatatatttgtgagcaaccctgggcatagaaaaattattatagcaaattaaagcatcctgtatgccgcttcatttattccctactcagtactttcaaaaaaacttatttgtttcttaattcacacaaacatatactttcatgcatttaattgtaactgaactacacatattagaaacccaaagatgtttattgattaagaacatttatcattaagccatataacttttaaggtttgagttatacctcatctgtattattaaaagccaaacttttgccataaagaaaatgttctgtataatttgaacatagttattaactgaccactttgcttatctcctggactgcaggagggttaaatggttccatggaagggagtgtgctctgggagtcaaaagttctgtagtgctatcttcaggttctccccttagcagccaagcgaaagtaccggagtcctacttttaaaaggatggctataccaatccgttttgcctaccccacaggttctttgaggggatgctattacccaagaagtcaaacttttaagtagggaacatggaactgcttaggtgttttgttttgttttgtgaacattttgataaaatgtggttccttttgttccctttaggttaatctcaaagaaagtcaatctaaaaataaaacagccattcttgctttggtgttctttactggcatcatgtatgcagatgtttatctcattttatcatttgtgtttcacaatcatacaagacgggttaaacttcaaagggacagaaaaagagcatctgacttatataacttcagtgatttaagactaagagtggttttacgtagctattagttactagtgcttaaataaatcacctctgaattgatgtcaaagcattcagaaacacttatgactccttggtcacatgctgcaagtattgtcaaaatacttaagtattgtcaaaaaacttaagtattgtcaaaaatacttaaaccaagtatgtttaaccaagtatgtttaaaccaagatatgtttacctgtatttctaattcatctgaaaacaatgaacttaattatagtcagcagtgtcctatgggttactaggctacttaaatatttaaaaatatttaaaaggttagatttgcaaactccatcatattttttactatctatgctgaaaatgtgggaacatttctaaccattcctttcccaccttctgaatttgaaattatactggatactacctcacagattgtcttccacaatgatggctgagtgtttgataaaaatatgtcaccctcagctgggtgtggtggctcacgcctgcaatcccagcactttgggaggccaaggctggtggatcacctgaggtcaggagttagagaccagcctggcacaacatggcggaagcctgtccctactaaaaatacaaaaattagccgagcatggtggtgcacgcctgtaatcccagctactcgggaggctgagacaggagaatcacttgaacctgggaggtggaggttgcagtgagccaagatcacaccactgcactccagcctaggtgacggagcaagactctgtctcaaaaaaaaaaaaaaaaaaaaagtcagcctgctctgctaagcagattcattcagtggtatatttttctcaagaatttatgttactttgggggggtgatgactatgttcatatcttgaatgtggtgacaatttcacagtatatatacctatgccaaaatgtattaaattcaaaagggtccattactataacttatgccaagttgattgtattatatctgccaaggttattggagctgcttagctgatctaccctctctaaactgcctaatcatttcaagggtgctgaaattcatttacaatgttttgcattgcaggtttcatctcaagatttttttccatgcctagcccattgaaggcaaatgccaactcttccgaattattcaccctccaactgacgcccacaaggctagaatacaccccatctcctgttaacatcaagtttaggatatattattatttaaatatcaaatcaatctgaaatgaagctcctgtaacagaaacaggtcgttttaagattttttaaaaaatttttagtcttgtagttatttgactttgcataaaccttgtagatacaaacatccatccagactttatacaattcctgaaataaagtcagtagatcaggtagcccagggccacagattcttctcaggcagatgctaaaccactaacctcagggccgaaagggccatatttgtgtccagagaaatcaggttgctcagaatagaaggcatagaccgaaggcctataagaaaattggaaggttcagaatctctcctaaaccacatgtaacaaaaaatatcacatatttttaaaaaacgcatttaaaaaaaaatgttctcaagtttaatttatcctttaactactattcatgttagcatgaaaaacttttttttttttctgttgcttctgtgaccaccaccccatctgtagtaactgtctggaaccaccttcaggaatcaaaagtcacaaaggaaaacttgaacctgtactcggatccttgaccctcaagataacagagcctggcggtaattcacatgggccgtgcaatctgcagcctgaaacaacaactaactgcattacagagaagcgtctctctttatacttctgcaatccttgggatgctgctggttcatttatcaaagccagaaactcccttcggctctgctgtagtggacagaattaatagctgcagtaatccaagtaattaaatggtcccaataaccaaagtctattgtatccttcttagggaagtaacacttaaggctaagaaccacaaaacttttaattccaaacattggctgtgcttctattccacagtctagtgtttcacgcaattctaaactaagatagaaatgtactgaagaaagaagaaagagagaaataaatacctctcatgatctggcagggtgagccactgcaatatggttaatattctccgctcgtgagggatgacactggagggtaaaagcaagcaaagcatgttgttaggtttcatttccgcaaactcaagcctgaggagtgctcgctcttgcacccaggccaaatgctctctatttaccaccatctgttttcacttcatttgtagtaaaaggccctctttcgaattagcgtttaaactactatttccatttgcaacatattacgttgctcaacctcttccacagaagactacactggaaactctgattcacagtcagaatgaggaacctgtcttgctaatcagaaactccactacaagcagaaaggaccctggtttcagaatcattgtcatttattctgtcgagcctttagctgtggccataaagggatcagtacttacatccccaatccgcctcttgctggcggtgtgacctctcttgaccactcggtctcagtttactcatcggtaagataaagctaacagcaaagaacactgtacagcttggttgtaaggatgaaatgagacaagacaaggaaagggcatgtccagtgcgtaagacacagtaagttctttaaaaacatatttttattaatgatcataatgcgttatcattctgcctctaaataatggtatgactttagaaacactacctaacctgaaactttaagttcctcctctataaaataatgggttagggaaggtattcttgccattttcttccagccctgtaaaaatctaccaagaataggccaggtgcagtggctcatgcctataatcccagcattttgggaagccgaggcaggcagatcacctgaggtcaggagttcgagaccagcctgaccagcatggcaaaaccccgtcactactaaaaatacaaaattagccaggcatggtggcacatgcctgtaatcccagctacttgggaggctgaggcaagagaatcgcttgaatccaggaggcagaggttgcagtgagccaagattacagcattacactacagcctgggcaacaagagtgaaactctgtctcaaaaaaaaaaaaaaaaaagaataggcacatataattaagagactgacaaaaagggtataatcttcatccacaataacttttgtgtttaagtctctttcctctgttgaaatataattaccctaagtctggcactagctttaagggctctaaggcctcacagctaacatgacagtattgcatccccggctgagttacattcagatgctcacaagctgagtgatatctttagtcaggggaaattcacccactctttcccaacagggagcacaaaatgcattttcactccccgatccaagaccaggcattagaggcatgttcatgatgaattcaaactaaagcacaagtttaaatgtggtcaggaaaaattattgtggaacattggtgagccatttaaacttttactctcagtggacatgagcagtgagagagctgggagaaggataaatcctcaagccggggctctcatcaagtggtttctcttcctcccccatcaccatccagctcacagggatttgtcattccccaggcaccctctctttctggaactatcacacaagaccagaaaatcatgtgtgccataaaatgagtccaaatttaaacatattccaatgctattggataaatgcgaccctgatcactatatcctataattgaattagaaataggcagagcaaagccaggttaatcacttaaggaatttaattcttcagctttagaaatcctttgtatctgagcaaaataattgcatactttgaattctttcctgtttaaaaaaaaaaagtgaatgccagagccttttcattatactttatttcactacctgcctaaaagctgctttattttacgtaattggtgttaagccacagaaacgggccctaatgaacccactttcaatactaatggaaaaatacaaactaacagaatctgtgtcaagctcagaatgctcacccctgaatgccctcgttggatggggtacttgaacaatggtagacggggaattaaaagtgccagctatgaggccagagtgcttgggtttgtatcctgactccaacaaatgctggtgataagacttggcaagttatctaaacttttgatgcctctggaaaacgaggacaatataatagtacctatctcataaagttgtagtaaaggtgaaaagagaatacatttagaatagtgaaaagcatttagaatagtgctgggcacatagaaagggtttagaaaaatgttagcttttattgttatatactaaatgtataggtctgcagagatgatatattcattcacaaaatatttgttaagggcatattgggtttaaggcatttgtgtaaacgtaaataaagatattcctaccaaaaagactattatggaggggtcgtcattttcttgggggaaagataagcaagtgataattcttttctgggcaggggctgattgtgtttgtgttgagaataagatgaggacgctggaggtctgagtagccatcctacctctgaccttaggtgcaacatttaacctctctaggccttagtgttctaacctctcaatctctctcttttttttttttttttttttggttgttgttgttgagatggagtcttgctctgtcgcctaggctggagtgcagtgacacaatctcggctcactgcaacctccacctccccggttcaagctattctcctgcctcagcctcccaagtagctgggattaaaggtgcctgccaccacgcctggctaatttttgtatttttagtagagacggggtttcaccatgttggccaggctggttttgaactcctgacctcaagtgatccacccgcttcagcctcccaaagtgctgggattacaggcatgagccaccacacccagcctctaatctcttaaatgaggagttgggcaaggttgtctctgtttcctaggagttctagattatctttatgaaataacctcagagaccaaaaggacatggcccttagccattagcatttcaaatattcaaatacaatgcgcagacagcacaaataaatctgaccaagaaagagcaaaaaaagaaatggggtacatgttgctgtcttcaccaccactgattgatgcagaatttgtcatgagaccaagtatattagaaatggtcaaaaaaaaaaaaaaaagactaagttaagtatttactagtaaaggagagcaaattatcttaagtcatatatagcccttgtctagtcaatgttgaaagagagaatgtgaataagaaaacaaataccatttattagttgttctctgtgtaccaaataccctaataagcattttatgttgttttattttattttattttttattttttgagatggagtcttgctctgtctcccaggctagagtgcagtggcatggtctcggctcactgcaagctccgcctcctgggttcacaccattctcctgcctcagcctcctgagtagctgggattacaggcgcccaccaccacgcctggctaattttttgtatttttagtagagagggggtttcaccgtgttagccaggatgttctccatctcctgaccttgtgatccacccaccttggcctcccaaagtgctgggattacaggcttgagccactgcacccggcctattttattttatttttgagacagggtctcactctgttgcccaggctggggtgcagtggtgccatctcagctcactgcagcctcaaactcctcgggcttggtgatcctcccacctcagtctcccaagtagctgggactataggcacgtgccaccatgcctggctaattttcgtatattttggagagatggggttttgccatgttgcccagcttggtctcaaactcctgtgctcaagcgatccacctgccttccaaagtgctgagactacaggcatgagcccccaggcccggccataagcattttaaatatgttagctcattgcatctttgcaacatcccatgatgaagataccatatatgtgtgtgtgtgtgtgtgtgtgtgtgtgtgtgtgtatttttttttttgagacagagtttcactcttgttgcccaggttggagtgcaatggcatgatctcagctcaccgaaacctctgcctcccaggttcaagccattctcctgcctcagcctcccaggtagctgggattacagacatgtgtccccatgcccagctaattttgtatttttttttttttaggagagacgagggttctccatgttgaataggctggtctcgaactcctgacctcaggtgatctgcccacctcagcccccaaagtgctgggattacaggcgtgagccaccatacccagccgaagatactgtaatttttatttgaagatgaggacatggatttgttgagagattaaatcactagtccaaggtcaccaatctaataagcagccaagctgggatgagaatcaacgtgaacaatcatacataatgggaattactgtctttgaacatgaattggcacaaaagaatggagcatcagccgaagattatttcagaatgaaatactatcatttaaaaggcaagaataattctaggttgcagtacggaaccatgttaaaaagatggccttcaaagtctaagtctatggtttgaatcaggttctaaatttttttaagttttcagaatatacactgtgtagatttccttgacgtatatattctcttaactaactgaaagtgtgatcctatttttttaaagttgtaaaatacttcaaaaaaaaggggaaaaaatgaatccaagtcactttcaggatacagagttaaaataatagtctgagaagcaaatgaaagctacagacatctttggagcatacaaaagccaccttcttataagtgatttcaaatgggtggagaaaattgccattcaaaaccagaacactgggccttttcaatgaggctttgcagcagtttcaggggggcaaaggtggggactcagtattaattatgttgttggctcctctccattctgccaggcaaatatgttacagaacagaagaaaatacttctatgagcgtctatgacagtcaagagttaaagaaatgtcacacataggataacactggtaaatcaacatgctgtttatattaagcagtatcatttccaacctacctacacttacttctcagctcagaaacctctttaaaaaaaaaaaaaagaaagaaagaaatctcttaaagggacagtgtgtgctagattcaaatcaccaaacccaatttcaatttagcccttcaaatctgaaaaagctacttttatttctgattttagagagtatagacagtaccgttctggattaatttgagcctgcagtagctctcagcacactgctattatagaatagtcagatttttgttaggcatacaggcaaatacagaaacagctttaggtggtttaaaaaaaaaaaaaagatggaaagaacatctcagtgggaacaaaatccccgtgaaagttgaaacagattccttttcttactaaggaaccttaaaaatcatcaacatgttgatacttttattaggtaagattcatcttaaggcttatgaacattaactgcttatccccccatcacttctttagggatgggaaggagccccactttcttattagaaaaatcctggagttcagtgggaaaatgaggtgaaaatagaggcttccccttggtctcctgtctggaactttcaatctctagacgactccttcggctccccagaggcctgagaccatctagatatttttaagttgtgaaccaaaataaatataatatgttgtcatatatttatagaaaatgataacgacagccactgccataaatagtctaagagaaatatacatgtcctagatggcaagttaccaaaaacctacaaacaggaatagaaaaatctaaaggacatccggaaggaggagagaccatcttacattctgttgagaggatggggctgggcacggtggctcatgcctgtaatcccagcactttgggagacagaggcgggaggatcacaaggtcaggagtttgagaccagcctcgcaaacgtggtgaaaccctgtctctactaaagatacaaaaaattagccgggagtggtagcaggtgcctgtaattccagccacttgggaggctgaggcaggagaatcacttgaacccgggaggcagaggttgcagtgagccaagattgcgccactgcactctagcctgggtgacagggcaagactccatctcaaaaaaaaaaaaaatagagagagacaggatggaaaaaaggagagctggaggacaaaaagaaggtaggatgaggcacagagggaggatctcaggaaaaaaacacctggaaggttattttgatttagtaaatattcaaaagttctatattttcacatttaactgaaacaaaataaaacttaaattgatgttttagaaattgaatcatagctgtcattttataaacattgacaaaataaaggtaacttacacagaccaaaagaatgttccagctttcaccccttgcttggtggctgtaatccatagctaatgaggaaaatataagcggcttaaaatgtgttctgtgtttttgtcaaagaagaaaaagtttttaaaatacattagatcagatatcttatactctactcacaccccaacataaattttccattatttgcaaccatttattttcacatctggaagtcagaatcattatttccacaaatgttattcaatatattctctgcaaaagctctcaaaagctcctgctatgattctagtgacatattttttaaaatcttattttatctcaaaagcctctctcttctgtacctgtcttttctgatcattgttttgaacaattaacttatgcagcataattctgctcatcaaaggacccaagagtgggccatatgtttcctttactattgaaagcctcaaggaggagtgccccaatttggcatccagatgtcagaattttggaatccagattgtcttgttttagtttaaactagatgaatgagaagggggaaaaaggctaatttttaattttgatttttcctaaatcttttacctagccttttagtaaatgttattttagaggaaagttcctagaataagttaagtgaaccaagcatttcatcaaggtttttaaaatattctttacaccgtgtactattggggaggcataagatataggagtttagaacctgggctctgcaatcagacagtttggattttaagccttgtttctgtcacttaccagccatgtagtcctttggcaagttacttaatatctttgtgtttctgtttcctttacaatgtaaataatcttatctagcatataggattattctaagctttaatgagttaatacatttaaagtccttaaaccagtgtcttaacatctggcaaacactcgataaatttacatatttattgttatgcaataatggaaataaataatccaattattctagtaatattaaaaacagcctaagatggcaagtgtcccactgaacagaagtctatgagaagaaaccccctcacttaaagaaagagaatggaagcaaatacgagagagaattgtggtttgcctaagaccaaaacaaaaatgatctgggaattgtagccagccccttttctggtttcattgtcaccagcctttgagagtatccttaaagagtgacaacttattttttgaggaaatgggtaactgggaggtggagaacatccagaagcttaaccattgtttcaaaatcacctgggatacctgccctgggaaagctcgaaaagggttccagcccccttggagcctctagaaatcctcagccccaaactaacagctactgtagctggcaaatgagggatggggcaggagaacgtacagagcactcttcagtctgtgggttctgagctgctggtgaatttcatcagcctgggagaggtaggggcctcatcctgttcacatggctctgagggaccagaccttcttggccagacttttggttccctgggatgtttggagacataagaatctcagattgttctgagagtccttcactccatttagtccaaagctctttctattttaaagacaaattctggcatcctccaggaaccccagcccaactagggttcagaatgtgtcctggactttcattcattcttgttccagcacctccaccagcaagaagatgagctcaaatgaagtgctggacacactataaaaccatgccagttcccaaagaggccagttccttatattaagggatctattttcatacttattttaattgcttatacacaatcttagcacattccaatatccaaacaacttcctagatgtactgccttgctatttccaagaagattgtactaggcaatacttggcatctatgaaatttaagattaatatggagtttcctaaaggaaaacacacttttaatacaaatttctcaaataatgacctgcactttcaaaaagtatacggtagaatacatgctgatgttggcatcattagggcaacaggaagttctgagagttaatttaactcagtaatccttagggaaaaaagatcactggaagaggtctttacagtgtcaaaaggaaggagcacacagagtgaaaatgacagggtatgttaaaattattatgatggcaaaattaagatcatttgttctttatatttttctgtactttccaacaattttacagtgacaatcaacttacttgtaatcagaaaaaaaaaactaaccaattttaaaaagcagtgtcttagaagcatacagtgtaaactatggaggcaatttaaaggtaaaatttgtatttcttctaaaaacaaaatcaaaaagcagaaaaattctgcctgtttcttggtaaaagtcaggttgaccacattttcaaaaagaaaattgagagcatgatcagaaaagtataaaaactgaacaaaaaagataaaatacttaaaatgaaaagcacattttcccaagggggggaaaaaggcactaaaatattggtccagaagaagaaaagtgaatacaagccgataaggttataaaagagagagagagagagagagagagagaagcttcccggttccttgttaattcagagatataagtgtcaaagtttctctgaatttgaatgcaatataaatttcttcagagggtagtttaaaaaaaaaaatcaggccaggtgtggtggctcacgcctataatcccagcactttgggaggccgaagagggtggatcgcctgaggtcaggagttcgagaccagcctggccaacatggtgaaacccatctctactaaagatacaaaaaaccagccaggagtcgtgataggcacctgtaatcccagctactcaggaggctgaggcaggagaatcgcttaaacccaggaggtacaggttgtagtgagctgagattgcaccactgccctccagcctggatgacagagtgagattctgtctttaaaaaaaaaaaaaaaaatacaactaaaaaaataagcttaagaaaacactgggtttgggctttctccctctaatcccaaaactccctgcattgctttcctttatctggaggcccagctttcaacatttgtgtcctagatgctgctttgtgaaaaggggacaaatgggaatgacattgtatcttgtgatgtgctatttattagaaatcaaaaaggcttcctccacaggaaccaagtaggttaaatatgaaattcaacactttctcaaattcagcatgtagctttgggagaaaaggagaagtttggaaaaagaaaaatattagccaaaaacattttttcaaaaaacataaactactagtgcagtctttctagcagttcctcgaagggaaatcattcctttgcactcgaaagcattgagctaggataaacagaattctaggagaccaggggatcggtggagcacttgcttcagcagatcaatcgctgagaatcagaacaaattaagggtgtgggggttgggggaggcagcagaagagactggggcccaatgcagctggtttccacgtgattagggccagaaggaggtgagtgaggaagctgttggcatgtggccggagctgccgaggctgagatggagtgctgtccttaaggccacctaccctaggggaagcacaggccaaatatgcccccgaaggaaacaaagaacagttccatccgaaacacaatagcggagccaggctctagattgggtcttcgaaacagaaatacaccaagtccctacctgcatgggacccgcagtgtaaagcagacctgtgaataaccaacttcaaaaggaggtggtcaggccgggcgccgtggctcacacctgtaatcccagcactttgggaggccaaggcagacagatcacttgaggtcaggagttcaagaccagactggttgacatagtgaaacgccactctactaaaaatacaaaaaaattttatctgggcatggtggcacacgcctgtaatcccagctacccaggaggtagaggtatgagaatcacttgaacccgggaggcggaggttgctgtgagccgagactgtgccactgccctccagcctgggcgacagagcaaaactctgtctcaaaaaaaataaaaataaaaagagatttccaaatttatgatagtaaaaatataaaagcccaaaggacagtcactttgcttagccagagctggaaatgctgggggaaggaaggcctcctcgggacagacacttcagctgaaatttggaagaaaaataagaggctggtaagcaaaggcaccaggttagcagagctcgccctaactaggtacatttggatacagtacaaagagaaaaaactgcaggtctgcggtagtatatggaaaagaaacaacagaataaagaataggttaaatgttcctgaaaagaaatattgtctctttatcaggacaataaaacagataaaaagaggttagcaatgacttgtactttccatcaagtcaaccccttttggcctggaaagtcacccctattctgtgtcattcttcttctcctgctgtctctgtcttaaacacacatttcttgcattttttcactgcagtcattcactaaaatggcttctgttccaactcattgtaccaccaatactggcagagagcaattctaggtcaagcaacttaagtgataagaatgcatctgctggacagttgcagttgggatcacgcctgtaataccaagactttgagaggctgaggcaggcaccttgcttgagctcagaagttggagacaatcctgggcaacaaggcgaaatgttgtctctacaaaagatacaaaaattagccaggcatggtagtgtgtgcctatagtcccacctgctcaggaggctgaggtgggagtgttgcttgagcccgagaggctgagactgcagtgagccaaaatcatgccactgcactccagcctgggcgactatactaagatgttgtctcattaaatataataataaatttttaaaaaataataatctgcttctcttagaaacaccttactccagaaatgctgacttcaggagacttggatcatgatggggtattaaacttgtttctcaaatctccacatttagtcaactcctaggaatcccattcattcctcccattgctgagaatccagatttaaacagaacagggaacaaccccatggaagtatctttgtattagaaattgcaggaccgtagcagagagaatttccaaagaaaccaacccacttaaggaactccattaaactacgtatgagaaatgcagggtcctacagcaaacgactgcttctagcaatgcatgttgagtattaacaaattaaaagcagactagactttaattgactatatcaaggctaaaaaacaaagattaaattaaattataaaagactaaattaaattattttcggaagacgcctatttagattcaaattttcaaatggccattgtacaattgcctcatcccatctactagagtttatgctaggacaagaagtggcttttattcaccatgtaatctgacccctatgccatttggctaaatgtcttgcatggtttagtccctcagtaaaaataaattgagtttaatttaattatcaatctaagatttgtataaatattttctcttataaatgtataaaaaattataagacttttataaatattttttcactggtgattttaaaacgaagcctctgagaggatggtataaatgcttgtagaatattcattaattttttcttatagtacttttagttgcttatactcttatactttgactaaagtttctttttaattactttttatttataactgacatataataattgtgcatatttatgggatacagtgtgatgtttcaatgcatgtgtacattgtataatgatcaaatcagggtaattaccatatccataactttaaacatttatcatttctttttggtgacaacatttaaaattttccatcttaaatacactacattgttatttgctatagtcaccctactgtataatagaacaccctactgtataatagaatagaacaatactttgtctatatgtttttccaatatgccaaatttcaataaaatgtgtttttaaattgtagttactatgctcctgggaaatcttttttttttttttttttttttgagatggagtctcgcactgtcacccgggctggagtgcaatggtgtgatctcaactcactgcaacctccacctccagcttcaagcaattttcctgcctcagcctcccgagtagctaggattacaggtgcctgccaccacacctggctaattttttgtatctttagtagagatggagtttcactatgttggccaggctggtctcaaactcctgacctcatgatccacccacctcagcctcccaaagtgctgagccatcgcacatgagccaccacgcccggcccctcctaggaattcttatggtggccatcttgcccaagatgacagaaacactagtcagtttcaccacaaatcttggtcagcatgaggagagtactaaacttggtcagatgcgtcaactttgggagttagtgaggaaacaggtaaacagagctgaaacagagacttcacttcattgggcaggttaacagcatttcctctgctctgcttttgcagaagttaatgaatatgtggcctcatcttcttctgagtcatcctaacccaaagcaaaccttatgtcaacacttggtgtaaggtgatccaatttgataaaattactatttatctctaatcctttaaggttcttcaggtaagtttgcttccataatcaaattaatataaaagacccactagtgaaagcttaatggagctctaatttcaatcattttgtgtactcataaaatattcccctatcataaactttgaataatccaccctgtcaacaaatttcactatgatcacaccctaggccattatggacttctgggagtccagcctgaataaagacagcagaatcagagcatctattataaagaaacttatctgcagatgtacaagaagtctttcaatgtttatttttttaataaaaagctcatatttatccttgcatactgatttacctattatgcaatataaatattttgatcacaaatgaccttttcttaaagtgagataccttaagaaaaaatttctatttatagtccttattttgtccataaattgcagcaaaagatttccaggtacaagatcattgaggcatggtggatacatggatgtgtgcagacactgcccaccagtcatgccacggttgagtgcacaaagttctcccagccctcttctctaaccagtgctgcaggaagccactgtctccaatcagaattggcatgagatggaaccacttaccatcttacttctacatgtttctgattgcctgtgtgccctgggttatgttcctaggtgattctgatacttctggccagaagcttgtacacttcagcccagctctgcacattcaacaactgtggctttatgctgctttgctcatgtctgaccaaagcaagttgcgtaaccatacacacggtcacaggaaaaacattaggtagaaagccacctacaaccctttttattttctgcccagtcatttgatctgaagtaaacagggtgatttcttttcaaagtattaatttgctatttcagtatcaaggtaggattctgctttttgtatttaacttcatgatttttaaaaaatagattaaataaaaaaattcatgaatttactgtggatttcagtgagttccctttttttccagcaagtttccctgtttctgttattatagcatcagggctagcatattggggaagtcacagtcatacacttctcttttttattatacgcctaaatctgggaaatcaatgagatctgactatttctttgtcaaaatggttctgaaattcacctcatcaccattgtcaccaccataatcctagggaagacattcatatcatctcacttttataatcatagcctcacaaagatgcatgcatatatacacacagagacacatacacatatgtatacatacatgtatattctatgtgcacatatgtatgtacacatacataaatatataatatatacatatatcagatatataatgcatatatacacatatttcagatatatatataatgcatatatacacatatttcatgtttgtatgtatattaaaagtatcaaaagacagaaacattgccaagtatgaggaaattatacgcattttttccacatctaacaaatttggggatgaaatgtctcaatacatgaacacacaaacacatagacacacaataaatgcaaaacttaccggttgacctccccaccatctatgattaaatttctctcgccctcgcagatgaaaagtggcatcaaatacaggatcatacattgaattgccaacaattccatgtgattctggatatagcccctttttgtaaaagcaaatttattgttaaaataacaatacaataatccacatacattagttctagtatgaattttcttagcatagaaggttttatagcaatacttaatttccaaaattatataagacatgtataaccttcactgtgtatctgtttgagcaaacatgaataatatctatgggacaaattataagccatctgagaaacttaatatgattataagaaatttaacattggggtttttttctgctgtaatttaagaagatgacaataattttcattacaataaattaacctttagtttggaatgtatacatgtgcctccaaagaagcttctatttctaaatacacttttctttctttctaaattctattgctccccgaatcaataaaaatatataaataaattatgttttaaagaaggaagagtggtagaatttgaagtacctgaaaattaaaatatagccctgaagtcaacatttttatttgcaaattcagaaaataaacaatagaccctctggtatttgagagaagtttaatgtatgtgttcaaacagaactgcacctgaaaaaagttttcagctttaaagttggaatgaagttccatcacccacaaagttgtaaaaggcatttgctgtgaacaaatgacccagttaagatggaaaacagaaagattttctttgaacactaaggaacacgttttaaaagtaaagtctctcctttaaagtcattccaggatgaaatcagccctttgaatgtgtatcattcgaaaaaatacttacagtggccaaagtgtataagttaggaaaggttttagttgggtacaccggcctcatgtagggagagtgtgtgccacaagaccctggaaagagaattgcaaatattagaacaagagaaccaacaggaattgcttatagaaaatccattttataaacactcagacatgtgttaccttcacttctgtatttcaaataataaaacacatttaaaactacgtgcccatagatctcaaagcccacagcccactggttagtgtggagatcctagattacagataagaacacagagtatggaaattacttacttagtttttcaatattaggcatgactttgctgcctttcttcatgtatgatgcacggaagccatccacggagaagatgattaatggagggcgaacaaaccttaaacagtaacacattaagcttttagaaacattattaccagagttgccattacgcctagtgattctcaataatgggagcaataatttccaagaaaaaatttcaccgggcgtgatggcttacgcttataatcccagcactttgggagtccgaggcgggctgatcacctgaggtcaggagttcgagaccagcctggcaacatggtgaaacccccatctctactacaaatacaaaaatcagctgcacgtggtggcgggcacctgtaatcccagctacttggaatgctgaggcaggagaatcacttgaacaggggagacagatgttgcagtgagctgagatcgcaccattgcactccagcctgggcgacaagagtgaaactccatctcaaaaaaaatataataaaataaaataaccgaacatattcatttaaccatttaaccacaagccagtcatggttaaatcaagactgcccaacaaaaatactctgtcagtcattcattatctgaattcttgtgtatgagatctgttaaggtacagattaagaagtcatgaaacatttctgttttgtaacaaataacacagtgacctgttattattcattggtagctttttttgagatgagctatcaaggctgccctttctgccttgttcttcatgcctgcgaagatcatttttgttccggggatgtgcttcttgggattctccaaatactccatgagtgtatcctctccccaggagatgcttttgttcttatgggcctctgtataagagaatccaatggcctgatctgtcttccccacaaagagaccatggagatttgacccagccacctgtttgcctcccttttcaacagtgtggaactgggcacacttctgaacaaaaattctcttgcctttttcaacatcacccatatttaattctctctttggttgctggtgctataaaggttcccattcagaagccagatgtcccactgccttggatgccttttttttttttagagggggtctctttcatccaggctggagtccagtggcacaatctgggctcaatgcaacctctgcctcctgggttcaagcgattctcatgcctctgcctcccaagtagctgggattacaagcgctggctaattttttttgtattttttttttagtagaggcggggtgtcaccatgttggccaggctggtctcaaactcctgacctcaaatgatatgcccgcctcagcctcccaagtgctgggattacaggtgtgtaatcaataagtaataattacttattggataacacagttttaaaggttctcaggacttcctctttcattccccactccccgcaaagtaggcaaaacaagaactccaggaaaaacaatactgaaaaaaagtcttagccagaatattcagatgcactttgtaaaatcctcagctgaggtggaatataggggatgttcagaccccaatatgtgcagaggtgattggagaaaactggggggaagaaaactatcaccatttcaagacctaccttcaacctttcgactcatgaattactcctaagtactcataagtttgcctgtataagagaatttcagttccacattgtttctaaatacttctcttttcatttcctgtgagagtttatcagctaatacataaaacttcaaaatagtcataaaatacacttaccctgcagggcattctgcggcctttatttcctcacagtcatcatcaacccaatgcgactctcctataaggaaaaatgggtaaatgtattgttgaatctaattacaaatgccatgccttgaagctcacaattccaggatctgtgtcctgtttgatactttctttatgggatataacaaaaaaaaaaaaaaattctgaaaaaaaaatctagtgtctggtttggcttataaagtacacccatacatgatgggaaagctaagatttaataaccacaagtggtgaggtgtttatttgagccttccgagtctaaatggtttgtagattaaaaaaaccagtggcgtcagtgaacaaaatttcatgtttgtatccctccagaaataaactgtttggtcattagatggaacattcttttctccaccactggagatctcaaagccatagaaagcatggcaaaacttccctttagatgctaaaaaaaaaaaaaaaagtcttagaatctacagagataataagtggaagattacaatagaaagattatttgccaataaatctccatacagcccttgaatttagaaagaaaaaaatgctaaatttcactttttatcttccaccaagatctaagagcataatgtcgagaatagagaacagaaaaggcctcagataaaaacataagctttgctttgaagaaaatacaagttatcaaaaagaatttgccttaaattattttaagacaaacaaaagttacatatcctgaacagaagtaaaatttgtaaccaacacattggagaaattgctcccatgtaaagagaactggaaatcttctctggtcaataagactctaactactggacaatggggtaactattatgctccttaaaataaagaagatttgctacacatatagtaacccagagcacacacgtgggcctcacaaaagtactgaaactagaattttaaaccagtaaaagccaatgcttaatgattcaatgatcaatgattccaagggcttctttttttaaaaaaaattttatttctaacagcctttgtggcttcctggtacacttactgcacaggcaaattaaaaaggaaagggaaataaattctcaaccaattttatgcttcaaaataaaagcataattattgggtaggggaaattaacaatacaataattgtttgggtatggggaaattcttcaaatatattaatataacaccctcttgccacaactaaacaccttacatattgcagaagtaacttgatttttttcctgaaatcttttaatgaacttcttcttaaatgttccacatcagagataatgaaaaggacttgattttgaaatttaaaaagtgacttacaaacaatagataaagattcttggatcttcccatcaacttctataagtgggttgcacggcaacttaaacccattaaagagaataactgcatcttttatattttctgtagtccattaactattgttaattgttggaataaaagcatcatattctacaatcaaccagacaaagccaacactcatgcatatatggctttggggtataacaggaaatgctggccccctcatcccctttaccagcaagtacccccatccctgggcagttgccaatgccttggtgaacagtgtacatccaatagataaaaaagccctggttccttgcctcaagagtagtgacctggatttacttttcagagcaagcaatagagggaggcgaggctaactgagagcatgtcctcacttgtctctccacactcctccttccctatcctgcttccctttcctccgacatggttttcctgcagtatatccgtttcctcaataaactgcatgtaccgaattcctgtctcaggatctgcttctagaaaacttgacctaaaaccaagataggaaatttagaaatctcttcattattatgtttctgtctaattaagaaattctggtttcttcccttgttacttcagatcagtgaaatacagagtagcaaaactaatgaagaagcatgagaaattaaaaaggacaattcattccttcctcccaaactcatatccagtgtggtctattcctagcatccaggatctcctggagcacctccagtttttattcttttaaagctcaggccaatccaaagaaacacgtacctttgcaaaccacttggtaattggtacagcagtctcccctggccaagcagtcctctgagcagtgacaggcattttcttcatttctgacttctccacatctgtccttagtacactcccagccacgggctaaaatcatcccaataaaacattttcactgctgcacactaaccaaatgaaagaagccacaattgcttacaggatttccaatgaagaaagctaaaatctcacatcatttactctgcttgtgaaatttgagttggcttgaggcccagaggacatttggagaatttacagataagatgaatttctaagttttcaaatcagagaacaacatcaaaatgcaattgggttcctttggaaaaatggggccctgaaaggcaagcaagtatccctacgattctcgaattgtcctaaaggacccaacaaatttatgacatcaaaggtttatgatagggctatctactgttgtagggacagcctctatagcttggctcttttaatttctgaagtgggtgtgcttagctttatttttattttatttatttatttatttttgacagagtcttgctctcttgcccactctggagtgctgtggcgcaatctcggctcactgtaacctccgcctccctggttcaagcgattatcccgcctcagcctcctgagtagctgggattacaaacatatgccatcacgtctggctaatttttgtatttttagtagagacggggtttcaccatggtggccaggctggtctcaaactcctgacctcaggtgatcctcccaccttggcctcccaatgtgctgggattacaggcatgagccacagcacctagcctaaagtagctgtgcttagcgttaatcagtgtgattcaaacacaaataacaggacaactacatggtttctatctgcacctggaggttaaagtcctaaataggatgtgaagagtataaagggggcattacaatgtttgctcaagattctaaccactgacccattgtggtcctacctacaatgacaggtcagagttcctactttcaagccaagtaaatgggttacagatttccctctgaacatacctgattgacagctcactgcttaattcttacatttcagaaaaacaacctttccattttaaaaggagtgctgtgttttttgactttttcatctgctagagtgtaagcgccatggcaggaaaagtgacacctctctcttcgctcttctatttccagtggcagactgtaagcctgggagactgcgcctggcacatgctaggtgttcaatcaatatgtattaaattgaattggaaatgaccatggagataaaatataactctttaaattcagaactactctattgagaactttcatagttaactcatttactcattgactcttataccatgttttccgtgttctcggtgccaggatgtcataaagaacaggagagactaggtctgtcttcatggagcttacattccaattggaaaagacagatcataggcaagtaaatcaataagcaagatcatttcagcttatgccaaatgttgtgaaggaagtaacaggtggcattgatagagaaagatagggtgaaataggtgctactccaggaagtagaatggtcaagaaaggtgtcactgagctaaaatacatatgaacacttcaggtctttatctcttaaaatatgtgataagtggaaagaaatgatttttaaagcaatcctgcctcttagtaatattctaccaagagaaacaactattgttaggtgaatacattaataaagagatattacgggccaggctcagtggctcatgtctgtaatcccagcactttgggaggccgaggcaggtggatcgtgaggtcaggagttcgagaccagcctggccaacatggtgaaaccccgtctctactaaagatacaaaaaattagccgggcatggtggtgcatgcctgtaatcccagctactcaggaggctgaggcaggagaatcgcttgaacccaggaggcagaggttgcagtgagccaagatcatgccattgcactccagcatgggtgacaggaggagactccatctaaaaagattaaaaaagagagagagatattagttgtttggcataactgctacccctgccccttttggtaaatcattagccagaaaaccatgcaattactatttaatttttattcttttagaattacctttgcatcctgattctgctgtctgatattttttgttgttttgttttgtttttttgagacagagtctcactctgtcgcctgggctagagtgcagtggcataatctcagctcactgcaacctctacctttcaggttcaagtgattctcctgactcagcttcccaagaaactgggattacaggtgcctccccccatgcctgggtaatttttgtatttttagtagagatgggatttcatcatgctggccaggctggtctcgaactcctgacttcaagtgatctgcctccctcagcctcccaaagtgctgagattacaggcatgagccactatgcccagccattctaattttttaatatcccgtttccattcctatctcttctcgaggagattaagtgcttagaattgcttttcccatgacctgctcttcccaatgatgagcaatcttctaaggttgctttgactctagatattgtggggttttttcaattcaaggtgattctatccaccaataaacttttattccactcctaattccataagaaaatcacatctacattacttacaaaagaatatcattattaataagctatgtttattgaggaactattgtctttatgtacaaatgaaatataaaataaatccagagtttaaagtgaactatacacaaaggacaagtcagtcatctgtgtaattttcaaagcaaacatgggaataaacataaaaaatatttaaccttattggaaaataaggaggaggtcacctaccagattattttaaaaatatttttaaaaataagagtattcaatgctgaaaaggaagtgatgaaaggtccttgtgtcctttagtagaaacataaactttcagaagtataatttagtaatgtatatttaaatttaaaaaaaatgcacatatactttgaccccaaaatcccacttccaaaaatttatcttaaggagaataggcaaaagtatgaatatgcatcaattatattcattgatacatcattcataatagtaaaactcagggaaatattcatttaattactcaatgaattaggttgcaacagttcaatggaatattacatagccattcaaaaggacgatttgtataaagatttattaatacagatactttcgcacacatgcatatatatacacacagttggaagagtatacatgcacacatagatacatactgaaaacacacacacacagagttatcaaagtttcgctgaaacattgtggttgtttctcggcagtgctccctcaacaaaggagaatctcagagccttttgtttttctattcatccttttattattatttgatatttgattccttcacattcaggatatgttatctttgtacacagggaaatggactataagatattatatcccatccttaataaattgaggaacaaaggcatgaactacattcaaaagagagctaagctagagtcagggattcattacattttgcaaagaattctaagaccaggaatccagaagtttgatatgacatgccacagacaagatattcaaggtaaggaggaaacataaaacattagtaaattcctcagtgccaagcaaacacagattgctggcttgaaataatgttttagagccaaaaaaactctgctggaacatctgttccatctatacattcagtttacaatagtctcagcaatttagtttgcagatccacaattaaaagaaactgggagaagttccaaaggaaagcaacccccaaaaaagtggttaaatggttggaaaatgtgttctgcaaaaaacagcctaatgaagctgttcttattgcagggacgcaggaggaaaacaaatcagaactagtaaggaagtttatgttggatttcatataaatcaagagctaccacttaggcaaaacacagtaataactgtttctaatgataaaatttgaaagatcaaactaatagcaatgatagtaagagttaggtctttgaaagaattgtctaagcataaaagtccaaaaacaagaaataacctgccaaggaaaccatggaaactgcttctggtgatgtcaagaacagcattgacggttgtctttctcagatagtttgtgtatggtgttgtccagaagcatggtggatagcttacaagatatctcaaaaatcctatctgaaatattgtgctttgaaaacagagtaggtgggatggcagaagtccccagaggtgtttttctcaactcatgtgcattcatacagaagcctgtacatcctagtaactgttccagcacaaaagaaatgtaaagaaagtcacaaaaagtgtggaggaagattttagagctacccagagcgtgagactccaaacagaattccataacaattttccatttgcagacggcagggaatgacaggcacactaacagttactgtacgataagatgaagtgaaacaaatgctagaagctgggaaagcaagaaaaaaaatttttttaaagaatgtacacaattaggccaggcacagtggctcactcctataatcctagcactttgggaggctgaggcgggaagatggcttgaagccaggagttcaagaccaacctgaccaacacagtgagatgctatctcttaataaataaataagtaataaaaaagaacatacacaattttagcccacaagccctagcagtgaatgtgggaattgacagaaagatatagaaaggatgaaggtgaagaaacaaaaacaaaaacaaaaaacatttgcaaaaccagcacatcatgactgcagctgcaaagaacctttctctgctggaacctatgtggaaacaatggtcattgacatagggtatgctcttcaaagaaccaataatcattcaacaaacaaaactagaatccacagtttggatagaccaaagcagggtggccactccaggatgcatacaatagcaggcagtctttaagccatctacttgaaggtagagaggactcataagttacgtacctgtcttcaaacacagctcatcaaagtcatggcagcaactggtatagctcttacacaagttgtcacagcgacaatcaggaggtccagcctcttgaagttcaaagcacctgcccttgcaagatccggagatgttggtccagggggagtctgatagcactgcaaagaacaagaggcaaaaacaatggactggagagtggtcatgtcaccatggaaaggtggcactgggaagctgtgcggtgtgatgctgcagtggactctggaggagaacactggctccattacttactacccatgtactctgggcaggttgcccaacttccttgttctacgatttcctcatctgtaaagtgggggactcataaaagtaactctatgttgaaaagagaattaaatgaatcaatccatgtaaaacacttagccgcatgtcagacatatagaaagagtaacaagtgttggtgatttgttcaattactatttataattattattactgcaaatctgtgatgattagtgcccctgtgggtgctaacgatgaccacagagaacagtaccttgatctatatccttagaaacaagagagcatgtccctatttaaaaatccaaaactttttacaaggaaaattcagctcaaatgttccaagaacagaacgaatatatgagattggaatagaagacttttacagtttcagctagtgttttacaaatacaagctctataatctgggcttctcaaaaaactcctccatcaatattttcacatgatataggtgtatatcagaaatcaaaagaatcaactaaaatttggggaaaaaaagaattcagtgagatcaaaattccacaaatttgtaatatgcacacaatatagtttcaaaattaaacagaagtttcattctcaatagggcctaaatgataaaatagctaggtattttatttggtataaatttaatcatatgtatgtagaaccaacatacatgagaaaagtctaccaaaaaaaaaatttttaagatctaattaaggtgggggcaaggtgcctcatacctgtaatcccagcactttgggaggccgaggtcggtggatcatctgaggtcaggagttcgagaccagcctggccaacacagtaaaacccagtctctactaaaaatacaaaaattagcccagcgtggtggcaggtgcctgtaatatcagctactcgggaggctgaggcaggagaattgcccgaacctgggaggcagaggttgcagtgagcagagatcgcactattgcactccagcctgggtaacagagtgaaactccgtcttaaaaatatatatatatatatatatatatgatctaattaaaatgaaagacataccaccttaaaggtaaaaatatcaatattataaaaatattaattcttcctaaacaaaccagaagactcagtgcaatcacagccaaaaatactgagagttcatgaaacttgaaaaaattttaaacacttatttaaaaataaaatattttaaaatagaaaacctctgaaaaggaaaagtaatttgataaagactagatagcaaagtatattctgaagttaaataatcaaagtagtctgatactagaaaataagtagattaatgttgtggatgggagccaatcagtaagtagggactataaataattaagttagggtctcatctcaatatacaaaataatttctgctaaatggaaaatataaacagcctcataactgtttccaggaattaaaatttttgtaaagtagaatataatttagaaagacctatcaacatgtttaaatgcttataaatgtttcacccagaaattctattactagaaatttaccatttacacatatttgcaaaagtttgccaagctacatgtacaaaaaatgtccattgttcattgcagtccttttattacaggtaaagagatcctgaaatcaaccaaagttgtttttcccgtcaagaaagaaagaatcgctatatccataagtggactattgcaccgtaagaggactattgcacactccttaaaaagaatgagtcagatcggtgtaggctaatatggaaagatctacaaaatatataaataagttgtttaaagaataaatacaggatagagtgttatatattagactttgtgtttaaaaatagagataaacagggcaataaggatagaaatgaagatagaaataaaaacagagccaaaactagagacgagtgagagacagggtagggcagaaggagggagaaaatgtccaagtttgcatcacgtttttaaaatgcaggtgtgaacaaactttttccttctgtaagaaacaggttatggaattacatttagggaaaatgagaaagaaagaggaagaagatttttaccttcctgatgtttgaaatttctaacattctacaaattcacaggtagttgcctggtctttttgtttgcttacttactttctctttccttctctctcattatatataaataccatacaatatatgtgcgtgtgggtatgtatatttatgtacaaaatatatactgtataatatatgtctgtgtgggtatgtatacatatgcacaaaatatatgtcatatatgtatgtgtgggtatgtgtatatgtacaaaatatataccgtataatagatgtgtgtgtgggtatgtatatatatgtacaaaatatataccatataatatatgtgtgtgtgggtatgtgtatatatgtataaaatataccatatatgtaaatatcctaacaaatattattgacatgcgatttataattttattttcttatttacatgcttatgaatttttcattttttataattcatgttttacttttaaaatcaagaaaaagcaagaagcaggagaagaacagatgttaaatgtcacttctaggttcacccaagccatttatctgaacattctgctcatcccttagtcctttgtcctcgttaaagtcttaaagtcagagtcatccaatcccagcctttatggcatcagatcagttcaactaaagcaaacagatttaccagatcatgagatgtgaaacacttttgcatggttgctcctaggattttgaaagacatacaaaccgtacgagttcagtttagaaaataatattcatttccaatgcagtggtccataaagcacatttttctattgtctttgaccaacctatcaacagtgcatgctgaaccataagaaaccatggaggcaggaggggttgagaagtaaaacaaaaaaaaaattacaaaacagaaaaaaatagagaaagtcctacagtaaaaataaatataaggaaagtacttacaattgaatattccttaaggatactgcttagatagactcatttcaacagcgttctagtaaattttcagtagaattcattcccacgagctgcttaaataaataagcttagctatgctgatagctgagatacttcaaagagatctaaaggcaatttgtttacagatgtgcggtgttcctgcatgcatttgaaattgtcctgcaaccacgcgccttgctttccttcatcatcatttcttccctatttctttcttttttttttttgagacggagttttgctcttgttgcccaggctggagtgcaatggtgtgatctcggctcactgcaacctctgcctcccgggttcaaagggttctcctgcctcagcctcctgagtagctgggattagaggcacccaccaccatgtccagcaattttcgtatttttagtagagacagggtttcaccatgttggtcaggctggtctttaactcctgacctcaggtgatccacctactttggccttccaaagtgctggggttacaggcttaagccaccacatccggcctatttctttctttactttcagagtatctgtgtgaatttttagccacatttaatctttcttcactcattcacctgatttttactattttcttacaacattaatcattctctaaatttgtcctttgctttgtttttggaaaataattgaatctcacttaatagtcggtccctatcagttacagttcttgccaaacctaaagacaagcaaaactaaagacaactttgttagagttagccttacactcataatgccaagatgtatctcaaaagaagtactgtacttaagatcaagttattgacagcttcaaattagggtatactcctggggctgggtggattaggatatacctatgtcaaaattcattctcggatgatttgaattcagctgagaatgacaggaaagaaaaagggaaggtagtttgagccatatagaacctcttataaaccaataacccaaataaatttgagctgctatctctttttttttttcttttttttcttttctgagacggagttttgctcttgtcacccaggctggagtgtaatggtgcgatctcggctcactgcaacccccgcctcctgggttcaagtgattctcctgcctcagcctcccgagtagctggaataacaggcacccgccactatgcccggctaattttttgtatttttggtagagacggggtttcaccatgttggtcaggctggtcttgaactcctgacctcgtgatccgcctgccttggcctcccaaagtgctgggattacaggtgtgagccactgcgcccagccatgctgctatcttttttttttttttttttttttttttttttgagacggagtcttgctctgtcacccaggctggagtgcagtggcgcaatcttggctcactacaagctctgtcttctgggttcacaccattctcctgcctcagcctcctgagtagctgggactacaggtgcccaccaccatgcccggctaattttttgtatttttagtacagaccgggtttcaccgtgttagccaggatggtctcgatctcctgacattgtgatccgcccaccttggccttccaaagtgctgggattacaggcgtgagccaccacgcccagtctatctcttttaaataaaatacagtgagtgtatgatgacactcagtaatgccacacactcctgtgtgcaatggaaaagaccatcttgatgagtgtacaaaaaaaataaacaaaatgattaaattaacaaataaataaaatagaacaatagagtggaatattcactctgcctttccagggtctattccgtcccagccatcttctttcacgacaagctctagtcccaactgttttcctaggagttctgcaatccaccttcatattctttttttaatcattttttatggatgaataatagaggtacatagttttggggtgataatacattcatgtagttgataaaaatcaagtcagtatacttggagtcttcacgttccctgtccttctccctacacccagcctaagatgtttaaaatcaagaaaaatcaagaagcagaaggagaacgatgttaaatgtcatttccaggctcgcccaagccatttatctgaacattctgctcatccctcagtcctttgttcctgcatgcatttgaagtttttaggacttctctctttattgtacctgacgtaatgtcaaatagggaaagattatccgatttgttagaagtctgagttttaaaatctgttgtcttcctttacttgacctaaatcaagagaacattgatgtaagcacttcagatgtgtaacttattgagaggcgggatgaaaactgaaacatcaacaaacttgtggtatcccaaatttttcatcattactgagatggccgtaacagcgcagaaaacaactaaaacaaacaaaaagtactctccaaatgtatcaaggcagaaatatgtgataagtatgatggaggcttgaaatttcttatgaggcatttgctaatacctttatgagattcaaattctattgccgccttttaaaatacatattcaaatgatgttattttacttcaaagatgcaagtcagttccagaatcttgaaaaacaaatgttcatagctttatatagtgttcttttaaaaaatagaaacctcaaattttaaaatacacataggtacatatatgacatgtataacaacaatgcaatgcatttcttatttttcacagaagcataatttcatgatttaaagaaacaccaatgtaaaacatacgttatttcattcaaattcataattctgacagaaacaggtacaattacttttacttaagtcaactttatgtctaaaatattccatcttacaatatgtatagagaggtagggttgtagaattctagtgccggccgggcacggtggctcacgcctgtaatcccaagactttgggaggccaaggtgggccgatcacctgaggttgggagttcaagaccagcctgacaaacatggagaaaacccatctttactaaaaatacaaaattagccaggcatgggggtgcacacctgtaatctcagctagggctgaggcaagagaattgcttgaggtggaggttgcagtgagccgagatcatgccattgcactccagcctgggcaacaagagcgaaactccatctcaaaaaacaacaacaacaaaagaattctagtgccatctgttccataagatacaacaaaactattgatgatttaaatttttggaaggagcctaaccgatgacaaaagttatggccaaaacattacttgatctaaggctcccaatcatatttccctctaaatgtcccccgtaaagatgcaaatactcaaatctggatgatggccaatagaagaggcagtatttaagtttggaaacatttagcttagcctaaagggggaaggttcttctaagctttgtctgctcctgtttatgatactgctctctatctgttcctcccattctccttggttcttagcccaggtatttcctgaaagtgagagcaaaaccttaaaatgtgttaccagctgtggttataccagctccttttctcaagagcgttaaaacaggacaagttcccttatgtctgctgccctgtttgaagcataacccacagggcaaggcagaggacagtgtgcgtggcattcaagatgctgcccagctctagagttaatactgtattatgcctcttctggagtatatggttcgttctttctggtcatacttttttcgtattgaatttgccattttttattgatgcttctgacctcattttttagtaaatagaacttacacacaggtctacatgtcagtatctttgcttcctaaatacataactttttataaatatccattactgcaacatcactgttctctcctcttcacagctgctaggccagatttcataaacttttttttttttaataaagaggtccacctgggaagtttttaaacacctgtgctttcaaaacatttataaacacaatggtctgacctgcctcggtgactcatgcctgtaatcctagcaatttgggaggctgaggcgagtggatcacctgaggtcaggagttcgagagcagcctggctaacatggtgaaacctcatctctactaaaaatacaaaaattagcctggcgcggtggtgggcgcctgtaatctcagctactcgggaggctgaggcaggagaatcacttgaacctgggaggtggaggttgcagttagctgagatcacgccactgcactccagtctgggtgacagaatgagactctctctcaaaaaataaatacatacatacatacatacatacatacatacatacatacacacaatgtcctcatatagagctcacaaactagaaggaaaaaaaaagatttctacgtaattgaagttaaaagttaaaaactttacttcaacatctaaaccacttaaatagaatttaatggccatcagtagcataaatctgaatgatttgcacatctgctaccaaacaataaaatgttgtcatttaaaattaaaggtattgttaactcaataaggtataagtttaaacactggccttcaaacctaattgaagattaattaaatgaattatcatatacttaacaccttatagttctcatcagccttaaaggcattttcaaaaactttttcagataaataaaagcgactttatccccattttcctggttggaaaattagatctctaggccttgtatgagttagccaaggcctggataaaattttagatcatctcactgtaactacagtatttttttcattaatgaaaggtttttcaaacttttgtacatagttttcaaattttagaagttcttttcaaaatataattttggggaagatttgctgattttattgattcaaaaatctaggctgaagttcatggaagactgagatttctgagtatgtaaactagatagaggagtctctacagttttcagatagatgaaaaatcactacactacagccccatttaacaaagaactgaaaaatctgtaccctccttagcttccagttcagataatttcattccattgactcaaactccccaatttctacctgaaatttcacataaagccccatgacaggataatcctaatgaccgagttttgctcacagagcaaatggctgatctacgtcccctttacagtttcctgcattctcccatgccaacatttaaatagcttttcattgcagagcaaaatttctaaaattatcaaatgaacataaaccttctcacttctagttccattttctgatttccctatgattctcaaagaaaagctttatccataaagttgttagtgacagtctacatttcatatgaacctatgaatttcattcacatacttttcaactttcctttcaagccactaaaaacaatgatgaattaaactgagcttttaagtctctgttagccagctattcacaagctcacaaatttccttttgtcttttaagaattaaattacttacatatcaaagaggatattctatttccacctggagacagtttctaaatcacaagtttcaataaaatagactcctgcataacaccacaaacatacacactgcaagtgcacatgagtgcacagacacctgtagacatataaagtctcttgcagtcttaaaggcaaatcaagtgggccacatcagacatatgagaaaaagatgtcaaactaaatcacagttatggcttatattttcttagaaaatttattccacccatctcaccgtctcattaacctgaatgcccattgtatttacccaacagaattataagtagcttttctcatttcatatctcctaataaatctataaatcttttatgacctggtataaaaaatcctgttcagccattatttcctacgctaacaataaatccaggtaacaagtgtgttagttaattaattatgacagtctgtttgcactgccacaaccttgaaactaacaccccagtccatagtacagcagcgagggcatccatgtgtacagaacattctcagctattgttgaggactctgagaagctatggttactaaacaactgcatgcttttgaatggtggatctcactctgatcaatccgaagctagccatatatcaataccctttgtgttccttctatttgttgcacccttggagcactgagcttcccaggatttctttggcgcctaaaaatgttgttggaaataggcatggctgcctcctccccacctagtgtcttattcttacaggcttataaaattcacccagtattttctgatgggaaggcttttctaatggtcagaataaccagtcacatgtgtcaatcgagagagatcctttctaagcatatgcagcatttaaacgcataaagatatttccactgtctacaggatgcttttacctagtttactaagtacatccttgatttttattcaggagaaatcaaccacagttcctaaaaagcacataagctacatcaaaagaaaaattattcaggcatatccaaaccataaaattcagagttaggttgcattgtattctaagactaagcttcacgtggttagaagtttaataaattattttagatgatatcataaaggcctaaaataaccaacgacttaattaaataattcaaggagcaaattcgtgtagcccacttaagaccatttaggtttataaattataatatagaccatactacttttctagaagtggcatttattcattagttcatatagctattcttataacatggaaataatttactatacacaaaatattttcaaagactaataaatccaatctatacttttcaagttttccagtagtgagcacagaaattcaagaggcaatgaaacagaataattcctgggattttttttttttaatccagaaagaaaagtagaaatcatctaagtctgctcctcattgtacagctaaggaaacagacttcacaagtgacttgcccaacaccacacagcaagttacaggactccagggtaccagcctaggattttaatgactgttttccaaaagaagtcacctttaaaaataatgagtgactcaattttacattcattaaggaaacagcatttaattctttcaatctcagttttagccagagtaatatattaagaggaaacagaaaaaaaaagttccctttagtgttcattgaaaagaaccagcagttggctctcaagttgctagctttcccacatgaccatgctaaggatctgattcccctgtctgttcagtcacagtcagtgttaatgggagtgaaaaagaggcctttgaagagagcatttgctgcaaataaaaacagcattctctagctcagtgatccactgtcctctgcctccccaacagaagacgactcattttgtccatttggctccctggggctgcaagttttgtgatctattttctcactcttaaccccgccacaccccacttcaattcactaattcacttctaatattattctttcaacctactggcatgattcaaaagtaacttaattgatgtaaggaagatttagtattccatcaatgtatgtgtcctaacccggttgataataaaatttcaagctggctaaacagaggcaagtgatggtctttcataacaatcagatcaagacatacagagaaacacaaaattcacaggaagacagacaaacatgctggaatgtcaggaaaagtccagaaaatattgttccctagagtgcccattacttaaaatgtaattttttatttctaaaaccatcagcagctccaatttccaggaaattaaccaactcattgcttaagacctggtcagttaagccccctctgtctgcacaaggagctcctttataagaacactgtatgggaacactacttatggtgtagtgtattgtaaaaagaaactctttcactttggttctattatttaagtcaaggtacactattaaaacttacctttcctttgccataaggacacacaatgaggacaaatcaatcctgaaaactctttaaacacctcctctcttttatgtttttccaattttaagtaaatcttaaagtcctaaatttctgaagtttcataaagatagctcactgccttttttacttccattcctttttcctacatcagaactttctagtggcaaatactacatcctatatcatgtgacagcaaatcagatttgggtagctccaatattaaaccaacacctgttctcaccacttctactttagccttgtctgtgaacaagagttttaattgtatcctaacatttacaaatttgagtacaaaaatggaaatagccagttatgaaacaatcataaatgttctctaatgaaaaccacactctcccacctgaattatacacataggtggttttacccagagaaatttaggactaacttagttatactgcaagattgtattaaaaataaatattttaataagcttacattgattaccccgtatgtaatatttttaaaaaattgaaaatgcaaatagttttgacacttacctgtaggaggaccttcctcccatccttctgctctcttaattcgatgtgcagtgaatcctaagcagatattgactccaacggcaaaagtgaacagggatattatctaagagaataaagagaccaagttgtcaaatacagctggagaagactaaatcaaattacacaaaggtgattcaaatggcttcaatatcaacacccaatcctaccacttccaaaatgcataataaggtgctatcttaatttgcacaacaaaaaggaaaatgccaatcagtcactgattctgaagatcaagcatgtcccccgtcattcctccgttctcccacctgacacgactggaacgagctcctccttgccatgtcgaggattcttggaaagccttttgcagcgtgttctctttgccttcacggagtgcactgctttgaggctctgggtttagtctatt

SEQ ID NO: 323 - DNA, 81788 bp, Homo sapiens; identical to SEQ ID NO: 321
